United States Patent 12,616,207 (BOXWOOD ENDOPHYTE BURKHOLDERIA SP SSG AS POTENTIAL BIOCONTROL AGENT AGAINST A WIDE RANGE OF PATHOGENS) - sequence listing, part 4

SEQ ID NO: 4 - DNA, 1380601 bp, Burkholderia cepacia strain SSG
aacgagaaacaaaccatgtcgtttgaggcgtttgcaccgtttcgcgtgacggtgcaggacaccgacattttcggtgtcaaaggaggagcgggtccgccgctctgttgctgcacggacatccgcaaacccatgatctggcatcgcgttgccgcgacgctcgcgaatcatttcacggtgatcgccaccgacctgcgcggttacggcgcgtcgggcaagccgccgagcgacgcgcagcacgcaccgtattcgaaacgtgcgatggcggccgaccaggtcgccgtgatgcggcatttcggcttcgagcaattccatgtatgcgcgcacgatcgcggcgcgcgggtcgcgcaccggctcgcgctcgatcatgcggatgccgtcgagcggatgatgctgctcgacatcgcgccgacgctcgcgatgtacgagaaaaccgatcgcgcgttcgcgaccgcgtatttccactggttcttcctgattcagccggagccgctgcccgagacgctggtcggcgcgcataccgatgcgtacatcgaacgcgtgatgggcaaccggtccgccgggctcgcgccgttcgcacccgaggcgctcgccgcgtaccgggccgcgctcgcagccgggcgccgtgcatgcgatgtgcgaggactaccgcgcatccgcgacgatcgacctcgagcacgaccgtgcggatctcgagcgcggcaacaaggtcgcgtgcccgctgcgcgtgctgtggggcgagcacgggatcgtcggccgctgcttcgatccgctcgacgaatggcgccgcgtcgcgcgcgacgtcagcggccgcgcgctcgactgcgggcactacattccggaagaggcgcccgtcgcgctgatcgacgaactgctcgcgttcttcgaggcgcgcgacgcggccgcctgacggacggcacgggcggcgcgtgccggtgctcagcggtgcgcgccgtcgtcctcgacgagcggcggcagccggcgcggcaccggcgtcgatttcacgatcgcggtgctcgtctcggcgcgctccgtcactttcgacaggatgtcgtcgaggtgcgcgatcgtgcgcaggtagagccggcagatgaagcagtcgtcgccggtgaccttgtcgcactccacgaattcgggaatccggcgcagcatctcttcgacgagatgcaactggccgggcagcggcttcacgcggacgatcgcctgcagcgtgtagccgagcgcgcgcgggtcgagctcgacggtgaacgcggcgatcacgccttgcgcctcgagccgccgcacacgatcggcggtcgcggggccgacagcccgatctgccgggcgagttcactggttgcgatacgcgcgtcgtcggccagcgccgcgaggatcgcgcggtcggtcgcgtcgagcgacgcgacggcgggcggggaaaggcgtttcggcatgatcgctttgctttcgaaggtcaatcggctgattcgcttcagtttagccgtggttgcggcgaaagcaagtttctagaatcgaggtcatccactctctttcaatggagttcatgatggcctcgaatgaaattcgccgcggtgccgctgagatggtcgtcgcgatgctgatgtccggcacgatcggctggctcgtgatgtcgtcgcagcagccgctgacgaacgtcgtgttcttccgctgcctgttcggtgccgcgacgctcgcgatcgtctgcgcggcattcggcttcctgcgccgcgcgctgttctcgccgcggatgctcgcgcggcgacgctcggcagcatcgcgatcgtcgcgaactggctgctgctgttcgccgcctattcgcgtgcatcgatctcgatggcgaccgctgtctacaacacgcagccgttcatgctcgtcgcgctcggcgcgatcgtgttccgcgagcggatcaccgcgtcgacgctcgcgtggctcgcgctcgcgttcgtcgggctcgtcgccgtggtgcgcgtcgagccggccgtgctcgcggtgccgggcgaatatctggagggcgtcgcgctgtcgctcggcgcggcgttcctgtatgcgatctcgtcgatcgtcacgaagcacctgaaggggacgccgccgcacctgctcgcgctgctgcaggccggtatcggcatcgtgctgctcgcgccgttcgcccacttcggcacgctgcccgcgacggccgggcagtggctcgacctgatcgtgctcggcgtcgtcaacacgggcctgatgtacgtgctgctgtacggcgcgatccagaagctgccgaccgcgatgaccggcgcgctgtcgttcgtctatccggtcgtcgcgatcgtcgtcgatcacttcgcgttcgggcagacgctcgcgtggacgcaggtgctcggcgcgctgctgatcctgctcgcggcggccggcgtatcgtgcccgcgcgtcgcgcggcggtcggcaactgaaacggtcgtacgattcggcgtcgcggcgggtgtcacggcggcgcgtcgaatgcgagtttcgggagcggatattgcgcgcggatggcgtgcacatggcgagcaaaagcggagcccgcgcacgcgtggaagatgctgtaagaagttgtaggaaacacccgatgcgagcggtgcgcgtcgctcgtatgatgcgggctgtgacgttgatcacgttcacaggattccgatctcgatgccgttcgcccgtcaggctgaacggctttttatgcgccgctcctcgcaatcacgcgccgccgcgcatcgagccgcgcgagcagcacgcgcctcgcgtcgtcatccgacgtgcgccatcccttgatttcgtcgcgcgtacggaggcaacccgcgcaccagtcggtgcgcggatcgatccggcatacgtcggtgcacggcgaggccaccgtgccgaccggtgccacggcgtcgctcatgcggattcccgcaatgcgacgtccgcgaccggcgcgcccgtcagcgacaccagttcgttcggcgacaggttgaacaccgcgtgcggatggccggcggccgcccacaggctgtcgagctcgagcaggtcggcgtcgatcagcgtgacgggttcgacgagatggccgatcgggcagacgccgccgatcgcatagccggtgttgtcgcgcacgaacttcgcgtccgcgcggccgaccgcgccgacctgcgcggcgaccttcttctcgtcgacgcgattgacgccgctcgcgaccacgagcaccggcgcgccgtccgactggcggcgaaacaggatcgacttcgcgatctgcgcgaccgagcagccgagcccggccgcggcctcggccgacgtcttgccggtttcggcgagcatcacgatgcctttcgcatggccgcgctcgcgcagcgcagcgcgacgcgtcgcgcggaatcggggagggaatcgaatgaagcgggtgtcgtcatgttgaggaatccatcgaataccggggttatacgcagttcgcggcgtcggccgcgctctgcgcctggcgagcaatgcgcgaccggcgcgcgacacgttcgcgcggccgatcgcgttcgagatgaagtcgccggcagcgacgacctgcgcgtcgacgccggtgtcgatgccgaggccctgcatcaggtacagcacgtcctcggtcgcgacgttgccggtcgcgcccttcgcgtacgggcagccgccgaggcccgcgaccgacgcgtggaagatctcgatcccttcgaacagcgccgcgtagatgttcgcgagtgcctggccgtaggtgtcgtggaagtggcccgacaggcgttcgcgcgggaacacgcgcgtgacggccgacagcacttcgcgcgtgcgcttcggcgtgccgacgccgatcgtatcggcgatgtcgatctcgtcgcagccgagcgccgcgaagcgctcgacgacgtcgacgaccgatgcgaccggcacttcgccctggtacgggcagccgagcgtgcacgacacgctgccgcgcagccgtacgcccgcatccttcgccgccttcgcgacgggctcgaagcgcgcgatgctctcggcgatgctgcagttgatgttccgctgcgagaacgcctcgctggcgcgccgaagatcacgacttcgtcggcgcgcgcggcgagcgcattctcgaagcccttcaggttcggggtgagcaccgagtacacggtgcccgcgcggcgctcgatgccggccatcacgtcggcgccgtcggccatctgcggcacccatttcggcgacacgaacgacgcggcctcgacgttgcgggccggcgcgcgacagccggtcgacgagcgcgatcttcacgtcggtcggcacgaaggtcttctcgttctgcagcccgtcgcgcgggccgacttcgacgatcttgacggcggtggggaacgtcatggttgtctccaggtttgcttgcaggttcagtagccgcgcgtgtagtcgacgatgccgccgatgcgctcaccgcgctcgagcgcgcggatcttgccggcgatctgctcgacggcctccgcgcgcagcgtctcggccgagctgtgcggcgtgatcgtgatgcgcggcgcgcgccagaacggtgatcgtcgggcagcggctcctggtggaacacgtcgagcgtcgcggcggcgatccggccgctcgcgagcgcgtcgagcaggtcggcctcgacgagatgcgcgccgcgcgcaacgttgacgacatacgcaccgggcgcgagccgcgcgaatgtgcgggacgacaggatgccgtcggtgtcgggcgtgctcggcagcaggttgacgagcaccttcgcgccgtcgatgcacgcatcgaacgcaccgtcgccggcgaaggtcgtgacgccgtcgagctgcttcgcgctgcggctgtagccgcgcacgggcaggccgagtgcggcgagcgcgagcgcgacctgcgcgccgagcacaccgaggccgagcacggcgacggtgaagctggcgcgcgcatgcggctcgagcggctgccagcggcgctcgcgctgctgcgcgtcgtattcgtcgaagcggcgcaggtagcgcagcaccgagtgcgtcacgtattcgaccatctgctgcgccatgcccgaatcttccaggcgcacgagcggcacgtgcggcggcagcgtgcccgttgcgcacggtcgagcgcgagcagcgcgtcgacgccggcgccgaggttgaagatcgcgcgcaggccgtcgcgcgggtgaagaattcgcgcggcgcgcgccagacgagcgcgtaatcggcggcggccgtgtcgcccggctgccacgcgcgcagttcggcttccggcagcgcatgcgcgatctcgtcgcgccacgcgcctgcttcctggtgcggggaatggaacaggatcttcattggacgactgcgcgcgcgccggcgaggcgcgtcacgggaacggcgagcggagccgggcgcggtgcgccggcgggcgtagcggacatcgggcgtctcctgacgaccgggcgcccggcgcgcatcggcgcccggccccggttccgtgtgaagctgacgggaagcccacattctacggtttcgcggcgcatcgcgcgccggtgcgcagggcgggcgatctgcgcgggcgaccggcgtggccgccccgcggatggccgccccgcgcaaaagcaaagcacaaaatattggttcggccgccgggcgcgccgcgccacaatcgaatcccgtcttcaagcaagcgagggcaatcatgcgcgcatgcagcaaatcggcgtggccgccgcgctcgttaccgttccgggcctgcacggcagcgaaggcgctcactggcagacctggctcgaacggcagttcccgcgctcgctgcgcgtcgagcaggacgactgggacgcgcccgatctcgcgcgctgggcgcaatcggtgcgcaccttgctcgaccgcgaacgcgggccgttcgtgctggccgcgcacagcttcggctgcctcgcgaccgcgcatgcgctcgcgcagtggccgcgtacgggcgatgtcgcaggcgtgctgctcgtcgcgcccgccagtccgaagaaattcacgtttgccgggccgttcgacgcgcgccggctcgccgtgccgtcgatcgtgatcggcagcgagaccgatccgtggatgccgcttgccgacgcgcgcacgctcgcgcagcacctgggcagcgcgttcgtgaacctcggcgacgccgggcacatcaacaccgcggccggcttcgggccgtggccgcgcgcgaagtacttcatcgacacgctcgtccactgcgcggcaccgctgcgctttcgcgacgcggacgacggcttcgaggccgcgctcgtcgatcgcgcgctcgcgcccgcgatctgattccgccgggccgggcgggcgacccgtgcggcgcggcggggccgcgccatgccgtgccgtcgcgcttatgccgcggacacgggccgcaccgccgccggatccgaatagctcggccggccgttttcgacgtggcccgcgaaacggcgcgagaacgtgccggccgcgccgtcgatcgccgcgtgcgtcttgtaccacgagtggtcgagatcgccgacgcactgcgcgctcgtcgtcagcgtgttcagccggaacggcagcaccggcttgccggggtcggccttcgacggctggtaccacaccggcttgccgttgggcagcgggatcgggaagcggtcgttgtagccgcgtacgccgcgcaggtgtccgaagtaatggtcgaacgagcggttttcctgcatgaacacgacgatgtgctcgacatcgcggatcgtgccggtgccgcgcgcggcgggaatcgcgagcgcgcggcggatcgattcggggaaggcgttgagcgcgacggcggcgcccgcggattgtgcgacggtatgcaggaaacggcggcggctcgatgacgtcatgttatttcacctcggttctgcggtcggggacggaagcggcggggtcagcccggcgacgacgcggcggcactcgacgcggccgcatttgccgcgggttttgcgtcgtcgtcgtcatcgggcgggtagtgcacgacgggcggcgcgagcggcgcggcgtcggatgcggcggcgttcgcggatgcatcgcggttgaatgcgctggcggagccggccgatgcgccggcctgctgggacgcgtcggtcgtgcgtgcgtcgtgcggcgcgtcgtcgctgcaggcggcgacgaaagcggcggcacaaaaacgacgacggcggaaacgcgacgcatgacttctctcctggcaggctgatcgggaaacgttttcgagtatgccggtgcgatgcgacgtttcggtgaatcgtttgcgactgtcgcgtgatcgcggattgctttcgatatcctgaccatccgcctgcacggcgtggcgggcgcgcaatatttcccggcggacgttgcgaggcgggcacttttacccgggcgcgcgatgcgatgcgtgaacgcgtccaaggcagcctgaccgttgacgatgaacgcgagcaaccgatcgcgtcgcgtcagtgccgcggcgtgcgccgccgcacttcgctgcgcagccagtcgagccaggttcggatcgccgattcgtgcggatggccggggcgccacacgacgtagtgcgcatacacgtcggtcacgcgcaccgacgatacgcgcacgagcgtgccgtccgcgagttcgggctcgatcagcgagcggcgcgcgagggcgacgccgcgccctttcaaggttgcgtcgatcagcgcgttcgcatcggtgaaacgcggcgcacgcgcggattcggtgagatcgagccgcgcggcctggagccacggttcccacggctgcgcgggatggcgcagcagcgtggcgcgcacgagatcggccggcgtgcgcggtgcgacgccgtcgcgattgcggtacgcggggctcgcgaccgggaagatcgtctcgttcatcagcttctcggcgaccacgcccggccacgtgccgggcccgtagcgcagcgcgacgtcgatgcggtcgcgcttgcgcagcggcgcgagcgccacgtccgggtgcagcgcgatcgcgatgtgcggatgcacggccgagaagcgcggcaggcgcggcgcgagccagcgttcggcgacgctcggcagcacgctgacgttcagcgtgacgtcgcaggtgcgcgggcggctgcgcgtggcgagggccggctcgaacgcgcgctcgagcacgctgaggccctggcgcacctgcagcgcgagcgcgtgtgctgcgtgcgtcggtgtcgcgccgttgcgctcgcgcgtgaagagcgggtagccgagctgcgcctcgagcgcgcggatgtgctggctgacggcgccttgcgtgagcgcgagcgcgtcggccgcgcgcgtgaagctctgcaaccgcacggcggtctcgaacgcgcgcagcgtctgcagcggaggaaggtggatgcgtttcatgctggtattagtagcactaatgcccgagcacgacaattcatcgtttgcggcgggcatgcacgcgttcctacactcggttccgtcttccacagtcccgtcgggccacgccaccatgaacgcatatcgtctctatctttcgccgggcgcctgctcgctcgccgctcacatcgcgctggaggaaaccggcgcgccgttcgacgtcgagatcgtctccgtgcagaagcagcagaacctcgaagcgcgttatctcgcgatcaacgcgaaggcacgcgtgcccgtgctcgagattccgggcgagccgcgcgtgctgaccgaaacgcccgcgatcctcacgtatctcgcgcgccgttacccggacgcgcaactgctgccgctcggcgacccgctgcgcgaggcgcgatgccacgaatggctcgcctggctggtcggctgggtgcatggcgtcggctacggtgcgctgtggcggccgggccgcttcatcggcgatcccgcgctgcacggggcagtcagcacgcacgggcgcggcgtgatcgaagccgcgaacgagacgatcgaagccgcgctcgccgacggccgcacgtgggccgagccgggcgcgcattcgatcgtcgatccgttcctgttcgtgctgtatcgctggggtgtcgcgatcgggctcgacatggcgcggcacccgcatggaccgcgcatgcgcagcgcgaggccgaccggccggccgtgcgccgcgcgcttgcgcgcgaagcggcctgaccgaggtgcgggcgccgtggcgggggccgcggtgcccgcgtgccgctagcgcgtggcgaacagcggatacgtcgcgccggcaaccagcgcggccgcgagccagaccacgctccacgaactgacggcgagcagcggcgggatcgcgagcggcgtcgcgaatagcccgaggtagacgaccgtgttcgccatcccgagcgcggtgcccgcgtggttcgcacccgcgagcgtcgcgagctccgtgtacgcgacgccatgccacgccgatacgcacacgcccgcgaacaccagaatcgcgacgatcgcggcgagcggcacgtgcgggctgccggccgtcgcggcggcaagcagcgtgaacgatccggccgcgacgagcaccgagccgcgcaggtacgcgcgccggttgccgtgccggtcggtatggcggccgctccagacgcgcatcaccatcgcgccgagctgcaacacgaccatcgccgcgctgatgccggcgaggccgagccggccgaagtcgtgcaggaacaccgtcgcgaacgtgagcaccgcgaactgcggcgcgcacagcaggccgatgccgagcacgatgcgccacacgcgggcgctcgcgagcgggccgtgcgcgagccgcgcgggttgcgtgggttgcgtgggttgcgcgggttgcggccgagcggccggtcgatgcgcggcaccgtgtgcgacagccggttcggcgggcggttcgtgcagccagcgccaagtcagcacggccgacccggcgcacagcagcatcagcgcaccgaataccgccgcgaagcccagatgcgacgcgagcgacggcagcagcgccgcgccgacgccgccgccgagcggcacggccgtctggcggatgctcatcgcgagcccgcgttcgcgctcgccgaaccagcgcatcaccgcgcgtccgctcgatccgttcacgctgccgccgagcaggccgacgcagcacatcgccacgacgacgcgcgccagcggcggcaccgcgtgcgcgctcgggacgatcgtgcacaccatcagcgcgagcatcgcggccgtcgcgacgagcccggtcagcagcacgcggcgatcgccgaagcggtcggcggcgatccccacggcagctcggacagcgcgacgccgaagccgagcgcgccgagcacgaggccgagtgcgccgttgtcgaggtggtaggccgagcgcatccacacggcggtggtcgggatgccggccgccgcggccgaaaagctcatgttcgcggccacgccggcggccagcacgcgccagcgatgggccgggccgcgtacatcgcgggtgggcgaggaggggaggcgatgcaggttgtatccatggcggaaggcccggttggaaattgacatccacagtctggcgacctacattcatcctgaaaatcggaaagttcttgatgaatcgttcgataaaacaggatggttgaaatgcccggacaagacattccacgcggcggcggcgagtcgctcgcgctggccgatgccgcgctggcccggcccaacttcgacgtggcggcgctgcgcagcctcgtcgcgggcgtggatctcggcagtttcgcgaaggcagccgaccgcgtcgcgcgctcgtcgtcggcggtgagcgcgcagatccgcaagctcgaggagcaggccggcacgccgttgttcgtgaaatccgggcgcgggcttgcgctgaccgatgccggcgacgcgatgctgcgttatgcgcggcggatgatcgagctgaacgacgaggcggccgcggccgtgcgcggcgtcaatctcgacggctgggtgcgcgtcgggttgcaggaggatttcgggaggcgattttgcccgacgtgctcgggcggttcgcgcgcgcgcatccgaaggtgaggatcgaggcgcgcgtggcgcgcaatgccgacctgctcgaccggctcgacgcgaaccagctcgatctcgcgctggtgtggggcgatccggtgtcggctgcgctgctgtcgcggccgggtatcgacagcgaggtgatcgcgcaggtgccgatgcagtgggtcggggcggcgggggcgggcgggttcggcgtgccgggtggggccgacgagggcgcggaagtcggggcggctgccgcgcacgcctcggcgggcggccgtgccgcgggcgaggcgctgccgctcgtcgtgttcgaccggccgtgccggttcttcggcgccgcgaccgatgcgctcgaccgcgcgggcgtgccgtggcgcattgcattcaccacgccgagtctcgccgggttatgggccgcggcggcggccggcctcgggctgacggtgcgttcgcattacggactgcccgcgtcggtgcgcgtgctcgatgcggcttcgctcggattgcctgcgttgccgagcctgccgctgatcctgctgcggcgcacgtcgtcggcgacgccgaccgtcgaccggctcgcgtggatcgtgacgcaggcggtgcgggatgcgacggagggcggtggcggcgctggcggcgtgacgaaacgttcgattgccgccgcgggttgcggtttggcagtccctctgccgattggccgaatggatcgatcgggtgaacctgactacagtgatgatcacttgaaacggaggtcgtcatgcaaaacgcgaatacgcccggcgccggtgcggtcgatccggcccaacgggcagataccacgatccgcggcgacggggcgtcagccggtcgactcgtgtctgccaatccgcccgttcggttcggtgtcctgcaagggcaggcccggatcgcggacgatttcgatgcgccgctgcccgattacctgctggatgcatttgaagggcgctgatgcggctgttgctcgacacgcacgtctttttgtggatcgtgaccgatgaccccaagctcagcgcacgggcgcgctgactgatttcggccgccgacgagcgcttcgtcagcagcgcgagtagctgggaggccgccatcaaggccggcttgggaagctcgatatcgacgtcggcaagctgatccgagcgatcggctcgagcgggattcgcgagttaccggttcgtgccgtgcatggcgcggcagcgcgcgatttgccgcaccaccatcgcggtccgttcgatcgcttgctggccgcgcaggcacggctcgagccgcttcagctcgtgacggccgatacccatcttgcacggtacggcctgtctctcgttctgacagtttggagcgatttgtcggcacgaaagccgtcggtcgccggcgcctcacggggcgtcacgggtcatgccgctgcggcgtccggtgcggtttcgtccagttccgcgcagagcgcggccagccgttcacgcaatccttcgctcgccggcacgaacggcagccgcaacccgtcctcgcaccaaccttgcgcggccagcacggccttcaccggtgccggattcggctctgcgaacagcgccgcgacgagcggctgcagcgcgaccgacaggcgccgcgcatcggcgagccggccgtcgcgcagcagtgcatggatgtgcacatgccattcgggcagcacgtgcgcgctgctcgcgatcgcgccgtgcgcaccggcgcacatcgccgcgaagttctggttgtcgtcgccggacaggatcgcgagcggcgtgtcgtgcacgagccggctcatccggtcgagcgtgccgccgcattccttgatgcccgcgacgcgcgggtcgcgcgcaagcgcctgcagcgtgtccagttcgacgttcacgccggtgcggtacgggatgttgtagacgagcaccggtaggtcggccgcgtcgacgatcgcctcgacgtggcggcggatgccgtcctgcgttggccgcacgtacacgggcggcgtgacgagcagcccgtccggccgcaatgtcgcgagttcgcgcgcacgcgcggccgcgaaatgcgtcgcgctcgcggtcagcccgacgacgatcggcagtccgggcgccgcgtcgcgcagcgtcgcgaacacggcgtcctgttcgcgtgcgtcgagcagcacgccttcacccgtcgtcgcgcccgcgacgaagcccgcgatgcccgcgcccgcatagtggcgcgcgagtcgcgcgagcgcggcatggtcgacttcgccgtggtggaacggcgtgatgatcggcagccagataccttcgaaacgtgtgttcatgcaaagcctcatggtggaaacggagtgggaaggaaccgttccgccggcggagggccggagcgaggcatgcgtgcaaggagaatgaaacgacctgcgggcatcccgtccggcattcgcctgacgggacgcgacgtccccgtcagtcgaggagtcgtttttcagtttcagcccggccgcgcgcgcacctgccgcgacggcggcgaggatcggaagcgagcgcagggcagcggacatggaggaaccgtgaatgggctgagcggcgatcttaacaccggattcgatgcgcacgcgagtgtccgccgccgtttagcaggaatcgagatttgctttccacgactgattggaaagcgcgccgcgcccggccgctagaatgcccgcttacgtttcgatgacagcgcgtacgcgtgccgtcacgcacattcaccaccactggaagcggggcatatcacgatggcaagcatgaaggggatcggccgctggctgcacacgggcgcggcggcggcgctggtcgtggcggcgtcggccgcgcacgcggacacgtcgatcctgaacgtgtcgtacgacgtgacgcgcgagctgtacaaggacatcaacacgggctttgccgccgcgtacaagcagaagaccggcgagacggtcgcgatcaagcagtcgcacggcgcgtcgagcgcgcaggcgctgtcggtgctgcaggggctgcaggccgacgtcgtgacgatgaaccagccgaacgacatcgacctgctcgccgagcgcggccagttgctgccgaaggactggcgtgcgcgtttcccggacaacagctcgccgtactcgaccacgatggtgttcctggtgcgcaagggcaacccgaaggcgatcaaggactggagcgatctcgcgaagccgggtgtccaggtgatcatcgcgaacccgaagacgtcgggcaacggtcgttatgcgtatctcgccgcatggggcttccagaagcagaagggcgcgaccgaccagcaggcgatcgacttcgagaaggcgatcttccgcaacgtgccggtgctcgactccggcggccggggcgcgacgacgacgttcacgcagcgcggcatcggcgacgtgctggtcacgttcgaaaacgaagtcgcgctgatggacaccggtgtgtcgggcgcgcagttcgacgccgtgtatccgtcggcgagcatcctcgcggagccgcccgtcgccgtcgtcgacaaggtcgtggacaagaagggcacgcgcaaggtcgcgcaggcgtatctcgactacctgtacacgccggaagcgcaggagatcatcgcgcagcaccatctgcgcccgcgcgacgcgaacgtgctgaagaagcatgctgccgagttcaaaccgctgaagacgttcagcgtcgagcaggtcttcggcagttgggcgaacgcgcagaagacgcatttcgcggacggcggcacgttcgaccaggtgatcgtcgaccggaagtgagcgccgcgcgccccgcgcgcctgtccgcacgctgacgacgcagccggccgcttccgcggccggctttgtgcctggcggccggcggcgcggcggacgctcattccaaaccggcacgcatacccggctgcggccgcgcgtgctacgctcatcgccttcctgcttccggcgccgcgcgatgaatgtcgattcgtcctccccagcctcccgcggccgtggccgcaagatctggtcgggcacacgcccggtcattgcgtacgggatgccgccgctcggctggcgcgacctctatcaccgcgcgctgacggtgagctggcccgttttcttcctgtcgctcgccgtgctgttcctgctgctcaacggcggctttgcaatgctctacctgcttggccatgcgtcgatcgcgaaccagtctccggccgggttcggcggcgcgttttcttcagcgtcgagacgctcgcgaccgtcggctacggcgacatgcatccgcagaccgtctatgcgcacctggtcgcgacgttcgagatcttcatcgggatgtcgggcatcgcgctggccacggggctcgtgttcgcgcggttttcgcgaccgcaggcgaagatcctgttcgcgcgctacgcgatcgtccggccgctgaacggcaggatgacgctgatggtacgcgccgcgaacgcgcgccagaacgtgattgccgaggcgcaggcgaaattgcggctgatgcggatcgagggcacgcacgagggctacacgctgcgcaagatccacgacctgccgctcgtgcgcagcgagcacccgattttcctgctcggctggaacctgatgcacgtgatcgacgaatcgagcgcgctgttcggcgagacgcccgaatcgctcgccgcgcgcgacgcgtcgttgctgatcacgatcgaaggctcggacgagacgaccgcgcaggtgatgcaggcgcgtcacacgtgggtgcatggcgaaatccgctggcgtcaccgctatgtcgacctgatgcacgacgaagacggcatcacgcacatcgactacacgcattttcatgaagtcgtgccggtcgacaccgataccgacgagcgcggctcgccgggcgcggtggtcgatgccgatgcagcggcgccgggcccggccgcgtaggtacgcccgcgggcgattggcggcaccgcccgcgcgcgacgcgtcacgcatgcagcaggcgcgccgcttcgcgctgttcgatcgcgaccgcgcggcggaatgcgtcgcggtcctcggcgcgcgcgacatagtcgccgagcacgccttcgtgcggcagcagatgcgcgtcgaacgcgatcttcagcgtgctggcgagcagcaggtcggccgcggtgaagcggtcgccgacgagccatggatgatgggcgagcgtttgcgcgagtgcgcgttgcacgcgcgtgatgttgccccagccgaatgcgaccggattgcccgacgcgccggtgaattttcggccatcgccggttcgaggcaggtcggcgtgaagaacatccattggagaaagcggccgcgcagcggatcgtcgggcgcgatgccgagcccggcacccgggcagcggtcggcaagatagagcagcacggcgcccgattcggcgaacggcacgctgccatcgtcgagcgcgggcagcttggccatcgggttgacctgcacgaacgcgtcgctgccctgttcgtgcgagcgcaggtcgatcggcacgagttcgtacaccacaccgagctcttcgagcatccacaacgcccggaatgcccgggtcttcggccagtagtagagcttcatcgtgcctccgtgattgggtgcagctgtcggtccggtggatgctcaagcgtacccgagcgccggaggttcggacaggggcgcccggtgagggcggccatctgcgagcgatggccggacgcgtggcgtttcgagtggaaaaccgggcaaagctcgatgtgacaaggaagtaaacgaataactagtcatattaatactagttatgaacgggatgaaaaattccggcgaagccggcgtcacttgcccggcgtcgtgacgcccgcagtgcccgtgcgcacggcaagactcgcatccggctgcattcgccgatacgacacgaaacagggaaatcatgggagacaactcacgcatggcaaacgacgatcgcgccacgatcattccgggaagaacgccggagtcggcggcgatggtggccgagatcaagcgggcgatggcgatcgccgcgcggatcaaccgcctgacattcgacgatgccgcggaagtccgcgcattgttcggcgaactgatcggcacgccggtggacgacggcttcgtgctgatcccgccgtttcatgcgacgggcggcaccggcatgaagctcgggcgcaacgtgttcgtcaaccagaactgcacgttctacgatctcggcgggctcgcgatcggcgacgacgtgatgatcgggccgaacgtcagtctcatcacgtcgggccatcccgtcgaaccttcgcggcggcgcgatttcgtcgtcgcgaagccgatcgtgatcgaacgcaacgtatggatcggcgccggcgcgacgatcgtcggcggcgtgacggtgggcgagaactcggtggtcgcggccggggccgttgtcacgcgggatgttgtgccgaatgtgctggtcggcggcaatccggcagcggtcatccggtcgattgccgagtaacgccgcgcggggcgcgagccgattggacgcagccgagccggacggatgtggataacccaccccgaggcgactcgaaacgctgtgcatttgaagggtgagggtgccgccgaggacgacggggcaaggcttcccggccatcggccggtttccgcgcgccgcctcgccgatgacgaatgaaggacgcttcgcacagccggttgtggatatcaccacggcaaacgactcgacaggctgtgcagatcatcggtgaggatgacccgatgcggcggatcgcggaatccggggtgtggataaccgaccgctcgcacgacgcgaaatgctgtgaatttccagggtgagcgagcgtacctgatcaagtgcattccgtcccggcgacgatgtggatatcctgcccggaaacgactcgtcgcgctgtgcatttcacaggtgaggaccggcgagtgtgtcgggttgcagcgtcgcgattgtggataacatacatccgacagggatcgaaatgctgtgcaatccaacggtgagtgagcgcgcgatggagatcgcgcacgcgccaccttgtggatattccccacccgaagacactcgaaacgctgtgaattccaagggtgagggtgaacacccgatcggacaggttgcgtcgccgattccgatgagcatcccggcgcggggcactcgaaaggctgtgcattctaacggtgagcgtccgagtaggcgagcgttgatcgtgcgcggcttcagtgcgacgagtccggatcatgcacatcgaccgaccggagcgcgcgggccagttgcatcgcgatcgccgggacggaccgggcggtcgtgtcgaccgtgaggtcggcgcaggcctcgtagagcgcttgtcgctgcagcagcaggctttgtagcgtcgcgatcggatcgtcggtctgcaatagcgggcgcgacgggtcgtgccgtgtcctggcgtggatctcttcgacggttgccgtcagatgtacgacggtgaagcggcgtttcagtgtcgaacgggtgcgcgcgcacagcacggcgccgccgccggtcgacaggacgacttcggggcggcgggcgatttcctcgatgatgttcgattcccggtcacgaaagacccgctcgccgtcgcgcgcgaagcattcccggatcgggtagcccagccgggcttcgagcaatgcgtcggcatcgacgaagtcgatcgacaggtgttgcgcgaggtgtcgccccacagtcgtcttgccggtgcccatcagtccgacgagacagatccggcaaccgctttcgcggatcgtctccggaccgtccagatggcttggccctgcggtgtccctggcggacacgtcgtcgtgctgtcgatgagcgtgggacatgttcaggccctgtcgagtaatgccgtgcggctccggggcgttgcgtcgacgacggagatcgcgcctgcgtggcaaggtgccggatcgtctgacggacgccaactggcgcaccgacagacaggccggtggaatgggcggcaacgactgcagactacagactgccctgataagcgagcacgctcgccttcagatcgtccggcagcaggatcgacgcgttggtcgcatagtcgaacgtgacgtgggttgacaggccgcgtgcgacaagatggtcctcgttgtcccggcgcgccagcagatactcgatgtcgaaactccgcgtaccgaaccggatgacgctggcgcgcaggttcagcacctcgccgagccgcacctgatcgaggtactcgcataccgtcttcacggtgatctgcgagatgcgttcgctgaacggcgcgtcgagcaatccgtacatgaatttcacgtacgcgtcttgcaggtactggtaatagaccgcgttgctgacgtgccccatgtagtcgatatccgaatagcggacgatgatctgctgagtgaagtgacgtttcggcatggtgatcgggaggctcctcttgaaagtgaaatggcgcgtgcgtcacgcgtgccggaatacgggggcgcttcgcgagaaatgcggccatgccttcgcgcctgtcctcgaacgcaaaggtcgcgtagaacaggcgtttctcgagatcgagcccggcggacaaaggcatctcggcggtgcgattgatggcttccttcaacaggatcagtgccggaagcgagtaggccgcaatctcctgggcgtacgcgatcgcgtgcgtgacgacgtcggcgtcggcgaccacctgcgtgacgaggcctgcgtcgtgcgcctctcgtgcggtgacgacgcgggcgcggaggcaccagtccatcgcgcgcatccggccgatccagcgaggcaggcgttgcgtgccgccgagcccggggatcgtgccgagcgccagttccggctgcccgaagcgggcggattcgcccgcgatgattgcatcgcaggcctgcgcgagttcgcacccgcctccggtcgcatagcccgtcaccgcggcgacgacgggcttgcgcacgcgcccgacgcattcccaggctccggtgagaaagcgttcgcgaatcacgtccgacgcgctgcgctcgaccatggcggcgacgtccgcgccggccgcgaagaacttcggatgccccgaaatgacgatcacgctgacttcgtcgtcgccatcgaggtgcgccaggtgggcggacagcgccgccatcagttcaacattgagtacgttcgccttcttgggccggttgagttgcagatgggcaacccgaccgatccgttccgcgacgacgagcatctcctccatgtggtgcatgttcatctccggtgtagatggattgggctcagttcgcgaacgcgctcagcccggtgatcgccttgcccagcacgagcgcgtggatgtcgtgcgtgccctcgtatgtattgacgacttcgagattcagcaggtggcgtatcacgcagtactcgtcggagataccgttgccgccgagcatgtcgcgcgcaacacgggcaatgtccagcgccttgccgcacgagttgcgcttcaggatcgacgtcagctcgacgctcgcgatgccgtcgtcggtcattcgaccgaagcgaaggcagccgagcatcccgagcgagatttcggtcagcatgtcggcgaacttcttctggatcagctggtttgcggccaggggcctgccgaactgattgcgggcgagcgtgtaatcgcgagcggtttcgtagcaggcggccgcggcgccgagcgcgccccacgagatcccgtagcgtgcggaattcaggcaactgaagagatcggacaggcgcttcacgcccggcaacacctgggaatccggaatcatcacgtcgtccagcacgattttccccgtcgtcgacgcacgcaatgccatcttgccctcgatgactggcgtcgacagtccggcggcatttcgttcgacgatgaagccgagcacgttgccgtcctccgccttcgcccagacgatcagtacatccgcgatgggtgcgttcgtgatccagttcttctcgccgttcaggcgatagccgccggtactttggtggcacgtgtctgcatcgcggcgggatcggagccgaggttcgcttcggtcatgccgaagcagcccacccattcgccggacacgagcttcggcaggtaacgttcccgctgtgcatcggtaccgaaatgcaggatggggaagatgacgagcgatgcctggatcgtcagcagcgagcggtaacctgaatccacgcgttcgacttcatgcgatgcgatgccgtagcagacggcgttgcgcgcttcgccgccgtactggtcaggcaccatgcagccgaacaggccatgcgcgcccatttcccgaaagatcgcccgatcctcatgctcgtaccggaacgcgctgcgcacgcgcggcgcgagtacgcttgtcgcgaacgtgcgcacgcgttcgcggtacgcattttcatcgtcggacagttcccgggtgatctgcagcggatcgagcgggtcgaatttcagttttgccttggtcgtcgtcatgtcgtggagccttgggtggagaggtgaatcgggagaggaaaggaaacggttgcaaacgaaaggagcgtccgtgtcggcttgtccgctttccggggactagaggcgccgccatagcgacgtgcctgcacgcgtataggtcgcaatgcggcaatgcgtgaccacgttcgccaatgcgtcgagcaacgccttgacggtgtcgagatcgacgccggtgtcgcgtgacggcagggcgggcggtatgcgcaggtcgaccagattgcgcaggtcgagcacggcgccacccagcacatcgcgatgcgagccgatcgtttcggctgccagccgggtatgccggagcatgtgcatgccgctggcgccttgcgagcgcaggtcgaccagcaggcgccggccgttgaccggcaacgccccctcgtcgagggtcgcgaggcgtttggtcaggcactcgccatcggcgagcggcagcgcccaaccgaggtcctccggcgggacggacggccagagcgtggcgatgaccggtgtatcggccgggattcgcagcgatgcgccgccgtcccacaaccaccacgaggacggcatgccggccccgcgcatgccggtgtgctcgacagccagcgagaagcccgtgcgacgaacccggcgtccaagcgttcgttcgactgtctcgggcaaggtgcgccggcaatccgctgcgagaaacggcacgatttccagatcgtcctcgtacgcggagcgcagtgcgttcaggcacttcatcgtgtcgcgacgcacgagcgtgtgcggcgtgcatcgaagcagcacgatcaggcggtcgtcaagtgacgtgaagatccgtttgacgcggtgcattgcatggtcgggtggccgaatcattgcgcacgctcctcgtcggtggctcggggagcgagacggagggcacagcacacatggccgagcgtgcatacgcgccgagcacggcaagcgtcgacgcccggcgcgtcatttccgccagcgcctcggcaaccggcgcctcgtgaggaaagccggaaagctcgagatagaagcagtacgtccacgcgccgttgccgagcgggcgcgtctcgaggaactcgatcgagacgccgtgggtttgcagggggcaagcaaaccggcgagactgcctgcgcgatgttcgatctcgacgcgtatcagcgtcttgccgctgctcgtcgagatgcgcggcacgtcgccgacgatcaggaatcgcgtgcgattcgatggctggtcttgaatcgcgcgagacagcatcttgatgccgtagagccggccggcccgctcgccggcgagtgccgcgtgcgtggtgctttcgctcgctgccttcgcggcggcggcattgctcgatacggcgcgccgctcgacgctcggcaagtggcggtcgagccagttccggcattgcgcgagcgcctgcggatgaccgagcacgcagtcgaccgtgccaaggtcactcgcatgcgacagaaggcagtgcacgatcggcaggatcacttcgccgcttgcgggcagcccggtgcgggcgagcagatcgagcgtgtccgcgatgcagccgtgtgcggaattctcgaacggtacgaccgcggcagaggccgcgcccgacgcgactgcgtcgaatgcgtcgtcgagcgtcgcgcaaccgatgcgcagggcggcgtcgccgaaaaacgagatcaccgcatcctcgctataggttccgttcgggccgaggaaggcaatcggtgcgccctgctgaaggctccgcgacgcggagaagatctctctcagatctggtcgacttgtgcagggcgtagcggcccggcgttgagccgcttgagttcgtcgagaatcccttgctctcgagacggttggggaatcgtcagccccgcgcgccgtttcgacaaaccgatctgctgagcgtgttcgctgcggcgattgagcagacggagcaattcgtgatcgatcgcgttgatcgaccggcggtgccgatcgacctcgcgttcatggggcgcgctcggcgcctgcgtgaggttgtccatggagccgaaagtgagtgagtcgagtttcgccatgccggggtgcgtgcccgatccgactgccggtcgaggcaggcggtggcggccgtcggtcatgcggtagacgaaagtgacgccagatcggcgcgggtaccggcaacgaactgccggcgagcacggaccgcggcggcgagccgctcgagcgtggcggtcgtgtcgctccagccgatgcacgcgtcggtgatgctctggccatagacgagcgccgtatcggcgccgagtggctggctaccggcgacgagattcgactcgatcatgacgccggcgatgctggcgtcgccggccacgatgcgcgcggcaatcgatgcacatacaggagctggttctcgtgcaatttgccgctgttgccgtggctcgcatcgatgacgacacgtggtgcgagtccgttcgtgacgagcaactcgcaggctgcggccacgttctgcgcatcgtagttgggcaccttgccgccgcgaagcaccagatgaccatggccgtttccttccgtcgagtaccggacgaatcggccatcgccatcgacgccgagaaagcgatggcggctgcgagccgagcggatcgcgtcgatcgcgaccttcaggttgccgtcggtgccgttcttgaatccgatcggacacgcgagcccggatgccatttcacggtggatctgggactccgtggtgcgggcgccgatcgcgccccacgatacgaggtccgcgagatagtgctgactcaggacgtcgacgaactcggtagcgatcggcacacgcagcgacgagacgtccagcatcaaccggcgcgcgatccgcaggccggcatcgacatcatgcgactcgtcgaggtgcggatcgttgatcaaccctttccagccaagacaggttctcggcttctcgaaatagacgcgcatcacgatctccaggtcgcgatgcagcgtgcgccggacgtcggacaggcgcgccgcatagtcgagcgccgcggccggctcgtgcaccgagcaggggccgacgatcaccagaagccgatcgtcgctgccatccaggatgcgtcggatcgcagcttgagattcgtcgacgaattgcatctcgtcgcgctcgaccggcaactcgcgccgcaggtgtgccggtgcggggaccaaaacgggaggattgcgttgctcgttcatgatttcctcgcaaatcattagcactgcaaaattgaaagtcgttttcaaggtcaaggcggacgggaccgtgctacgtcaagtcgcgcaaggcaaggtgacgcatttgaaaatttttctgccagattaaatcagtgtgtttggtaattcagcgtaattaatggcgagccgatccatctccgccgatattcgatggagtgtcatatggagtcggaaagctttttgaatgcaattagtaaataacttttgcatcaaaaacggttctcctcaccgtcccggaatttgccgggcagcgggaatcactgaattccgattgcgggacccggagcggcggaccggctcgcgtcatcccgccgcggtggccccgtcatagtggccgacgcgtccggtacgcgaagcgcaagtccgcgcgggcggcctatccggttgaaaagatgcacaaatgcgatgaaatcgatcgcttggttacgcggatgaaattattcacgtggccctctcgataatattcttcacgaatcgctatcatttgcggcgtgttgacagaattatggagttccctgagtatgtgttgaatatcgaaataattatatcaatcacaacaaatatggatgattgaccatggccacgctcgatgttgatgctgttcgtgtatttctattggttgcagaattggaaagttttacgaaggcggcggattttctcgatacgactcagggtgtggtgagcgtgaaattgaaacgcctggaggaacgcctgggctatcggttgctcgatcgcacgccgcgcagcgtaagattgtcgcgagaaggggatgcattcgtcgagcctgcgcgcgaattcgtcgccgcgcatgaccgtgcgttgcgcggaccggcactgcctcccgcacgtctggcgctcggcgtgagccacaatctcgtcggcacggaattaacggcattgctgtcgtctcttcacgtgttcgatcccgcgctgacggtcgaagtgcgtgtcgacaattcccgccggctgctcgccgaactcgacagccggaatctcgacgccgctatcgtacggcgcgtcgaggggcgcgacgacggctgcgtgatcgccaacgagcagatcggctggtatgcgtcgccgaacctgcatttcgaaccggggacgccgctacgtctcgcgtcgttgccggccacgtgcagggtacgcatgatggccgctcgggcgctcgacgacgcgggcattccgtggctcgaggtcttcgtgggcggaggcgtgaatgcggtcgcggccgccgtatccgccggcgtggccgtcgccgcgctggccaggcccgtcgcgccggcaggatccgtcgaggtcggcccccgattcgggttgccgtcgctgcccggctcggatgtcgtcttgcacagcggctcgctcggcgagcgtgcgagacatgcgcttcgcgcaatcgctgcgtcgtatggcagcaaggaccgcgtgacggacgcggcgtgattgcccttgcgggactgcgtcgtgtgcgctgcgacgcatcagatgccgcgtacggcgctcgtcgcccgctcgcgacgccacaccatccatacgctgaccaggaatcctgcaacgagcggaaccagcatccattcgaggccgatgcgcatcgcgtgcgtgtgggccgcggcaccaccactctcgccgagcgcgccgaagaaagcactgccgatggacgcggcggcgaccgcggcgccgatgtagagcatcgcgactatcgcgcccgcggtcatgccggcatggcgcgcgtcgacgtccgcgagcacgatccgttgcagcgacggtagggccaatccttgcccggttcctgcaatcaggagaccgatgtaaaacggcagttcaggcgcgccgtgtcccagttgcgatgcgcacaggccgaagccaccggcgaggcaaccgaacccgagcggcatcagaccctctccgatgcggcgcgcgagccatggtgtcgcgagcggtgcaagcagatagcctgcgccgtagggagcgaggccgaggcccgattgcagcggggtccagccgagtccttcctgctggtagatgccataggtcaggaagaacgcggcgatgctgtagaacaggaacgcaagcaacaggccgatcgccacgaccggctggctcaacaccgcgacgtcgacgagcggatcgccggaccgccgcgcgatgcggcgctcgatccggatgaaggcgacgaacgcggggacgcacaggcccagactccagaacgtccacgcgggccagtgcaattcgcggccgacggtcagcggatagatgagcagcagcagcgcaatcgtcagcgcggtcatgcccgggatgtcgatgcgcgcgccgcgcgccgcgcggctctccggcagataccgccaggtgccggccagggcgagcatgccgatcggcacgttcacgagaaatacgatgcgccagtcgagcccccacggacgcagatcgatcagcgcgccgccaccgatttgcccggccaccgatgcgagcccgaacacgaatccgtaaatgcccatcaggcgcgcctgcatgtgtgcggggaagacggtacggatcgatgcgaggacctgcggggtgatcagcgctgcgctgacgccctgtatgacccggctcgcaaccagcaccgtgccgctcgtcgccatcccgcacagtgccgatgccaggacgaaggctgccatgccgatcatgaagatccgcttgcgtccgtacaggtcgccgaggcgcccgccggtgatcaggacgaccgcatacgcgagcgcgtacgcggagacggtgaactgaatctgcgcgtcgctggctttcaggccgacgtggatcgacggcaacgccagattgacgatgaagtagtccagcggtgggaggaacacgccggtgtagagcgacgcgagcgcgaggcggcggcgcagggggacgcttcgatagtcatgcgcgtaacagggaaagaaatgacatggcttgcacgatagcaacaggtggcacaatcaactaagcccactttcgaaaaccggatcaatccactttcaagccatgagcaaacgcaccacgccacccgtctggggcgccttcgcggtcgatcctgccgctgcgctgccgctccaggagcagatcgccggccaccttcgcgaggcggtgctgcgcggccatctgcgtcccggcgcacgtctgccgtcgacgcgatcgttcgcggccgacctgggcgtgtcgaggcagaccgtcgtactggcgtacgaccggctcgtggcggagggttatgcacacgggcagcgcggctccggcatctatgtgccggacgtgttgccggaggacctctcgctgcccgctgccgcggcgcggccgtccgttgccgcggcgcacggcgaagcgtatccggcgctgtcggagcgggggcgtcacctcgtcaacctgccggtcacgccggtgccgcgcgaaccgggcctgctcgcgcccggcacgccggcgttcgatgcgtttccgtacgacacgtggacgcgtctttccgcccgtttctggcgcagccggccggctgccgaccagctcggctatgccgatccggccggataccgcccgctgcgcgaagcgattgccgagcacctgggcgtcacacgtggtctgtcgtgcgatgcggacgacgtcgtgatcacgtcgggctcccagcacgcgatcgaactggcggcgcgcttgctgatcgacgcgggtgccgcagtgtgggtcgaaaacccggggttcgtcgcgggacacagcgcggttgaaagtgcgggcgcccgtgtcgtgccggtgccggtcgatgcagagggcctcgatgtcgaggcgggtgtgcggctggctgcgggcgcgcggctggcggtggtcacgccgtcgcaccaatacccgctcggcgtgaccatgagcctgcggcgccggctcgcgttgctggactgggccgagcgcgccgacgcctggatcgtcgaggacgattgcgacggcgactaccgatacgccggccggccgctgcaccgttgcgcgcgctgggccggcagtctgccgcgaatcgcgtgatctacgtcggcacgtttgcgaaagtcctcgcgcccgggttgcggatcggcttcctgatcgcgccaccggggctcgccggagccttcgcccatgcccgcgcgttggtcgaccggcaatcgccgactccgttgcaggtcacgctcgcggaattcatcggcgaagggcatttcgcgacgcacctgcggcgtatgcgcatgctttacggggagcgccgggatgcgctgctggcggcgctcgaatgccactgcgctgacgtactcgactgggggccgcgcccgacgccggcctgcatctcgtcgcgaagctgcgtggcgcggctacgccggacgcggatctcgcggtgtgggaggccgcgacggcactcgggctgcagactccaccgctgtcgccgcactaccgtggcggtggcgaggccgggctcgtgatcggttttggcgcgacgctgccgggcaatatgcgggacgccgtgttgcgactgcggcgcgccatcgccacctgacggcgaggcgccggacagcccccggcatgccgggcaagattttcctcctgatcgtcacttcccgttgtgtttttgctcacgttggcggccgatcgcaaagatcagaaaaaaatcttcctttgtcgctgaaaaatagctgcattgacccgccgcgacgcggccgcattgcaccggcttcgcgatcgcgccagtgagagaacacaatcaggagacttccccatgaccgcccgcttgcccgtcgatggcacgcccgccttgtccgactaccgcctgaccgacaacctgaccgcgacgcgcggccggatcttcctgaccggcacgcaggcgctggtccgcctgctgctgatgcagcgcacggtcgacgccgaacaggggctcaacacggctggcttcgtcagcggctatcgcggttcgccgctcggcatggtcgaccagcagctgtggaaggcgaagaagctgctcgacgccggcggcgtgcgtttcctgcccgcgatcaacgaggaactcggcggcacggccgtgctcggcacgcagcgcgtcgaggccgatcccgagcgcacggtcgagggcgtgtatgcgatgtggtacggcaagggcccgggcgtcgatcgcgcgggcgacgcgctgaagcacggcaacgcgtacggttcgtcgccgcatggcggcgtgctggtcgtcgcgggcgacgaccacggctgcgtgtcgtcgtcgatgccgcaccagagcgacttcgcgatgatcgcgtggcacatgccggtcgtgaacccggcgaacatcgccgacatgctcgaattcggcctgtacggctgggcgctgtcgcgctactcgggcgcgtgggtcggtttcaaggcgatctccgaaacggtcgagtcgggctcgaccgtcgacctcgacgcgctgcagacgcactggccggcgcctgaaggcttcacgccgccggcgggcggcctgcacaaccgctggccggacctgccgagcctgacgatcgaagcgcgcctcgccgcgaagctcgacgcggtgcgccatttcgcgcgcacccacagcatcgacaagtggatcgcaccgagcgcgcaggcgaacgtcggcatcgtgacctgcggcaaggcgcacctcgacctgatggaagcactgcgccgcctcgacctgacggtggccgacctcgacgcggccggcgtgcggatctacaaggtcggcctgtcgtatccgctcgagatgacgcgcatcgagaccttcgtcgacgggctcgccgaagtgctcgtgatcgaggagaagggcccggtcatcgagcagcagatcaaggactatctgtacaaccgcaccgagggcgcgcgcccgcgcgtgctaggcaagcacgatgccgaaggcgcctgcctgctgtccgagctcggcgagctgcgcccgtcgcgcatcctgcccgtgttcgccgaatggctcgcgcgccacaagccggcgctcgaccgccgcgagcgcgtcgtcgatcttgtcgcgccgcagatcctgtcgaacgaggcggatgccgtgaagcgcacgccgtacttctgttcgggctgcccgcacaacacgtcgacgaaggtgccggaaggctcgatcgcgcaggccggcatcggctgccacttcatggcgtcgtggatggagcgcgacacgacggggctgatccagatgggcggcgagggcgtcgactgggccgcgcacgcgatgttcaccaacacgaagcacgtgttccagaacctcggcgacggcacctacttccactcgggcatcctcgcaatccgccaggcggtcgccgcgaaagcgaacatcacgtacaagatcctctacaacgacgcggtcgcgatgacgggcggccagccggtcgacggcagcatctcggtgccgcagatcgcgcggcaggtcgaggcggaaggcgtgtcgcgcttcgtcgtcgtgtccgacgaaccggagaagtacgacggtcaccacgggctgttcccgaaaggcacgacgttccatcaccgcagcgaactcgacacggtgcagcgcgagctgcgcgagacgccgggcgtcaccgtgctgatctacgaccagacctgcgcggccgagaaacgccgccgccgcaagaagggcgaattccccgacccggacaagcgcctgttcatcaacgacgcggtgtgcgaaggctgcggtgactgcggcgtgcagtcgaactgcctgtcggtcgagccgctcgagacgccgctcggccgcaagcgccgcatcgaccagtcgtcgtgcaacaaggactattcgtgcgtgaacggcttctgcccgagcttcgtgacggtcgaaggcgcggcgctgaagaaggccgccggtgccgcattcgacgaagccgcgctcgccgcgcgcgtcgatgcgctgccggtgcccgcgacgcatctcgacgcggcgccgttcgacatgctcgtgacgggcgtcggcggcacgggcgtcgtgacggtcggcgcgctgatcagcatggccgcgcacctcgaaggcaagagcgcgtcggtgctcgacttcatgggcttcgcgcagaagggcggctcggtgctgtcgttcgtgcggatcgcgtcgagcgaccggtggctgaaccaggtgcgcatcgacacgcagcaggccgacgtgctgctcgcgtgcgacatggtcgtcggcgcgagcgccgaggcattgcagacggtgcgtcacgaacgttcgcggatcgtcgtcaacacgcaccggattccgaatgcatcgttcgtgcagaaccccgacgcgaacctgcatgcggacgcgctgctcgagaagatgcgtcacgcggccggcgacggctacctgtcgagctgcgacgcgcaggcgctcgccgcgaagttcctcggcgactcgatcggcgcgaacatcctgatgctcggttatgcatggcagctcggcctcgtgccggtgtcgctcgcggcgatgatgcgcgcgatcgaactgaacaacgtcgcggtgccgatgaacaagctcgcgttctcgatcggccggatggcggccggcgatgcggcgggcctcgatgcgttgtggaacgcgcgccacacggtggccgcgcatgccgcgccggagacgctcgccgagctgatcgccgatcgcgaagcgcgtctcgatgcgtacggcggcgcccgctatgtcgagcgctaccgtgcgctcgtgagcgcggcgcgtgcgaagggcgacgacgtgctcacgcgcgcggtcgcgacgacgttctaccggctgctcgcggtgaaggacgaatacgaggtcgcgcgtctgtacacggacgatgcgttccgcacggcgctcgaagcgcagttcgaaggcgtgccggggcaggcctatcgcgtgaagttcaacctcgcgccgccgacggtcgcgaaggccggcagcgacggcagcgtgccgaagaagcgcgtgttcggccagtggatgtggccggtgttcggcgtgctggcgcgcgtgcgcagcctgcgcggcacgtggctcgacccgttcggccgcaccgtcgagcgcaggatggaacgtgcactcgccgacgactacgagacgacgctcgcacgggcgctcgccgcgatgacggccggcaatgcggcgctggtcgcgcaactggccgacctgcatgcccgcgtgcgcggcttcggtcacgtgaaggtgcgcaacctggccggcgtgaagcgcgcggagcgcgagctcgcactgcagctcggcatcgacgcggcgacgagcgcggccgtgcagcacgcgctcgacgagatgaagggcgcgggcatgctgaagggattccggtcgtggtcgcgaagtaacgcgcgctcgggcggatgtgaaaacggcgacgctggtgcgtcgccgttttttgtacgtcgacggctgcgtgccggcagccgccgttccgtcagagaatgcctttcttgcgcgtcgacagcgccgtttccgacaggtcgatctcgcgcagcagtttcgtcagcgtctcgtcggaaatcttgctgtcgctgcgcagccggtacagcgcggtgcgttccgcgcgcacggccgcgatccgcatctgcagttccatcgtttcggcctgctttgcttcggcgcgcggcgtggggccgtcctcggcgagcgtcgcgaggcggcggcggtactggtccatcacgcgtgcggagatatccgcgcagcgcgcggcgcccgattcgtcgagattggccgagatcgcgtcgtgcgacgagtcgatcgcgcggatcgcggcctgcgcggcggccgcgcgcgcggcgcgttcctcgtcgccgagcgggctgcgcgacgaacgcacgccgcgcagcagcagcggcaggccgatcaccgcgacgacgagcgagccgaggatcaccgccgacgcgacgaagaccgcggtgtcgcggcccggcagcggcacgccgtcggacagcgcgaccggaatcgacagcacgccggcgagcgtgaccgcgccgcgcacgccgccgaccgtcatcaccgcgatcgtgcgggtgccggccatcgtgccggcgaggccctggcgcgcggcgcgacggctcgcgaaccagcgcagcagccagacccacaggaagcggatcgcgtacagcgcgagcatcatcgcgcagacgttgaagatcatccggccgacgagcgcgtcgctcgtgtggtgcgcgtcgacgagcgtgcggccgatgatgtgcggcaactgcagcccgagcatgatgaacaccatgccgttgaacacgaactcgatcatcgcccacgtgctttcggcgcgcacgcgcgatgcgacggtgcttttgcgcgagaagctcgtgtaattcatcatcatcccggccgacacggccgccagcacgcctgacagctcgaggtgctcggcgaacaggtaggccgcgaacggcacgagcagcgtcatcacgatgccggggccggatcgccttcctgctcggcgttcaggaagcgcgtcgacagcgcgctgaacgcccacgacacgatcgcgcccgtcgcaaggccgccggccgcgacgatcacgaacgtgatcgacgcatcgcgcagcgagaacatgcccgtcagcgcggccgcgatcgcgaatttcagcgcgacgaggcccgacgcgtcgttcatcagcgcctcgccttcgaggatgtgcatcagctgcggcggaatccggccctttcctgcgatgcccgacagcgcgaccgcgtcggtgggcgacagcacggccgcgagcgcgaacgcgatcggcagcggcaactcgggtatcagccagtgcgcgaagtagcccactgcgagtaccgtcatgaacacgagcccgaatgcgagcatcaggatcgcgcggcgctgcaggtacagctcgcgcttcggaatccgccagccgtccgcgaacagcagcggcggaatgaacagcagcatgaagatttcgggatcgaacgtgacatgcaggttcagcttcggccacgcgagcatcgcgccgaaggcgatctgcatcagcggcaacggcagctggaacggcaggatgcgcgtgacggcgccggacagcgcgacggtcagcagcaggatcaggacggtgaagacgatttccatcgatacggcgaatacggggaatgaaacgatcgtacggagtgtagcgtgacagcgtgacgggtgcgttcgagcggccggtgcgtgcgcacgaaactggtgcgtcgcgcgtgtgccacggtggtgcggcggcccggtgagcccgcgcggcgcatgggttctacgcgccttgcacggagcttgcttgatgctggtcaaccgtccggcttcgaccgggcaaccgagggtccaaccatgacattgcacgcgccgttcgccttgccgggcgctgcgttcgaaggcattaccaggaggaaggcatgacgatcgtgcaacaggagcgtccggccgctgcatcgccgtaccggttcgagcgggaggtgagttccggcctcgaacgtctggcgacgcagcaccgcgacctgacgctcacgaccgtgttccagccgattttcagcctgtcgcaccagcgtgcggtgggctacgaggcgctgctgcgcgcgcacgatgcgctcgaccgcgcggtgtcgccgctcgacgtgttcggcgaagccgcgcgccagggcgaactgctgcagctcgaccggctcgcgcaggcgctgcatctcgagaacttcgcgctgctcggcgccgagcgcgagtggctgttcctcaacgtgcatccgggagtgctcaccgacccgttccaggcggccgcgctgctcgcgaacctgaagcggctcggcatgccgccgcgccgcatcgtgctcgaagtgctcgagcagcgtgcggaggacgtcgagcggctggccgaggccgtgcgcgaattccgcacgcacggtttcctgatcgcgctcgacgatttcggcgcgggccactcgaatctcgagcggatctggcaactgaacccggacatcgtgaagctcgaccggatcatgctgtcgcacgcggcgcaccgcaccgggctcaccgcgatcctgcacgggctcgtgacgctgctgcacgaggccggcaagctggtgctcgtcgagggatcgagaccgagcacgaggcgcagatcgcgctgtcgtgcgaggccgatttcgtgcagggctactacttcggccggccggcgccggggctgcccgacagcgcggccgcgacgggctgcatcggcgagctgaccgagcgttttcgccagcagaccgaggcgcgcgagcggcgcgatgcgcagcggctcgcgccgtacctgcgcgcgttcgaacgcgcggccgagcgcctcgcggccggcgagccgctcgacgaggtgtgctggaacttcctcgcgctcgacgcggccgcgcgctgcttcctgctcgacgcgcacggccgccagtcgggccgcaacgtcgtgctgcgcgccgaccgcgcgctcgccgaggcacgcttttcgccgctggcggacgcacagggcgcgaactggctgcgccggccgtatttccgctcggcaatcgccgagccggggcgggtgcaggtcacgcggccgtacctgtcgatcaacgaggcgcagccgtgcgtgacgctgtcggtggctgtgcgcgtcggcgatacgcagcgcgtgctgtgcggcgatatcgactgggccgacgacgaagcggacgccggctagcgacgcgcgcaccgcaggcggcgagcagggcgatccgggccggcgcgggcggcccgttgcgctcgccccgcgcttccccgacaatggcgcgaccgcggccatcgtgaccgcgggcgcgccgtcccggggccaccatggcggcgaataacaaggaaaacacaatgaaaagaccgatttcgctgaccattctcgcgtggatcatcatcgtgaccaacgcgatcacgtgcatctatacgccattcacgatcggcatgccgaccacccaggcgctgctgtcgcactacctgctgcccgtctgggcgacgctcggcatcagcgtgctcatcgaagccgtgaacgtcgtgatcggcatcgcgatcctcaagggccgcgaatggtcgcgcaaggcctatatcgtgacggccgtgttcggtttcgcgttctcgttcgtcaacatgccggcgtcgatgttcgcggtgctgatccccggcttcctgctgttcgccctgttcgtctacctgctgttccggcgccccgcgaccgcgtatttccgtcaggcgagcgcatgagcgtcgtgcgcaacgcgctcgcgatcgtgctgttcgcgatcgcgggcatgtgcgtgatcaccgcgcagatgatggcgttcatgaagctcggccatacgcgcgcgatgctcgtgttcgttgccgtgttgttcatgctgtcggccgtgttcctggccgtgggcgcgttcgccggcgcgttccggccgcgcgcgcgtggtgcgggcatcgcactgctcgtcgcgtccgcgaccaccgcgttcgggatgatcggctgggtgacgctcctgctggcgccggggatcgtcgacgtgatgcagcagcagggcgtcgacgtgaacgcgcggatgttccggttcgcgcccggcgccgtggtgaccggcttgtccgcgctcgtcggcgtgtggctcgcgcggcgcggctgacggtgcgactcgcgatgggactgatcgggcgccgctgacggcggggccccgtcacgctggcgcccgtcgcgcggctcggctaggatgcgcgaattgtcctgacgattcgcgggccgcccatgagccgaaacgccgcttcttccgtcctcctcgaagtgatcgccacgaccgtcggcgacgcgaaggccgccgcccgcgcgggcgccgaccgcctcgaactcgtgactgcgatcaccgaaggcgggctgacgccgagcgtcggcctgatcgaagccgtcgtggccgccgtgccgattcccgtcaacgtgatcgtgcggccgcacagccggtcgttcgtctacgacgccgacgacctgcgcgtgatcgagcgcgacgtgcgcgcggccgtcgcggccggtgcgaacggcgtcgtgttcggcgcgctcgacgcgcgcggcgacgtcgatctgggcgcgctggcccgcatcgcggccgcggcggacggccgcgcgctgacgttccaccgcgcgttcgacgtgtcgcgcgatctcaacgccgcgttcgacgcgctgctgcgcgtgccggccgtcacgtcggtgctgacgtcgggcggccatccgtcggtgctcgacgcggtcgcgacgatcacgcggctggtgcggcagacagcaggctcgacctgcacggtgctggccggctcggggctcacggtcgatgcggtcggcgatttcgtccgcgcgaccggcgtgcgcgcggtgcatttcggctcgggcgtgcggccgcgcggcgaggtgctggcaccggtcgacgaactgctcgtcgcgaaggtgcgtgcgaccatcgacggggccgcgtcgcacgtgtgaggcgtgcggctgccacggcgcgacgaatcacgccagcgcgcggcagacgatcgcgcggcccgcggcggcacgcgtaccccgtcacgtattgcgcacgaaccaggtacgtttcgcggtgcccagcagcgcgcgatagacggcccacgacacgacgaacgtcgcgggcgccgacagcgacgcggcgaaccccgtcgcctggttcagcgcgagtcccgtgaacgcgccggcgaaccatgcggtcagcccgcccggattgaaggtcggcacatgggcgtcgcggcattcgacgtcgtcgccgacgagttgcccgtaccggccggacaggatgtgcgcgagcgcgacgccgacccacgcgacgacgaagatgccctggtacgcgagcgcctgcaggattcgcgagaagatgtccgccatcatcagcgcatagacgaccgcgccgaccacgagtgcccacacgaacttcggcgcgcgcacgccggccaccttcaggaagaacgcctgcatgttgacggtcgcgaggtagtagttcgcggtgttgatgcgggattgcgtgacccacacgaacagcaatccccacacccccatcagcttcagcagcgcgagcacgaccgatacttcggaaagcgtaccgagccccggaatcgtgctgacgagatagatgccggccgcgccgttgacgagaaacgtgacgaggtaaaacggcatcccgaagttgaagcggccgtgataacccgcgtcttccttgcggccgaagcgcgcgtagtcgaacgtgaacatcatcagcacccacacgcccatgtagtagacgaagcagtgccaccagccgccggccggcgcgttgccggccggcccgaaatcgagccacgccgcgttgtagccgtattcggccgtcgcgagcccgaccgccgcgaggagcccgagcaggtagaacggcagcagcacgccgttgaacttgtcgagccagtgctgcacgctgccgaacacgagcggcacgctgtagcagacgacgagcaccgcggcccatttgtagtcgagcgccggaaactggtggtgcgcggcaaccgcgatcaccgagccctcgaacaccgcgtagtagatcgcggtcgcgaagaagatcagtgtcgcgagcgccgcgccggcgctgccgaacagcacgcgcgagaacagcgcgaccgagagtcccgtgcggatcgcatagcggctgatgatcgtgttgacgaggccgtacgacacgaccgacagcgccatcccgatcagcgcgttgcgcgcgccataggtgagcgcgagcgtggcgcccacgacgatgtagaacaccgcgctgcacacggcccaccacgccatcgtcagcgagaagggcggcatgcgcgcgtggtcggggacggcgagcgtcgacaggtcgagatcctcgtcggtacgggcctgagccaggttggccatgatcgtgctccttgatgcgtagaagttgcgaacgacgtctcggccgcggcacaggcgatccgcagggttgccccgacgtcgggcgggcaaccggttcggcaggaacagcgcgcaggcgtcccgccgcgcggcgctcggccgggcgggcggaagacggacagcgaaagggggcggcgacgaacggcgcccggcacgcgaaccgggcgcccggtgctcagtcccgcagcacggcgcgcagcagcgcgaggcgccgctggtactcgcggcgcgcggcgagcgcgtcggccatcgtcacgcgcacgaagcgcgcgcggtggttgggctgcatctggccgatcaggtccatgtcggcgctgatgaccgtgccgatcgtcgcgtagccgccgcccgacaccgcgtcgcggtgcaggatgatcggctcgagcccggccggcacctggatcgagccgatcgggtagcacgcgtcgacgatgttcgacggatcggcgcccgcgccgaatggctgctcgcgcggccggaactgcagcgcgcggccgttcttgtagcgatagccgatgcgatcggcttcgggcgcgaccgtccattcgtcgtcgaagaaggtgcgcgccgaatcgtcggtgagccggtagtggtacaggcccgtcaggacccgcagctcgacctggttgtcgagcggccggctcacggccgccggcagctcgcgcccttcgcgatgtgtgccgacggggcgcccagcggcaaccggtcgcctttctgcaggcgccggcccgcgtggccgccgatcgcgccgagcgcgtaagtcgagcggctgccgagcacgaccggcacgtcgatgccgcccgcgacggcgagatacgcgcgtgcgcccgccttcacgtaattgaacgacagcacgctgcctgcgccgatccgcagcgcgacgttgcagcgctggccgatgccgtcgatcttcggcgtcatctcggcgccggtgacggcgatcagcgcatccgtatggaacagcagctcggggccgagcagcgtgcattcgagtacggcggcttcttcgggattgccgaccagcagattcgccgcgcgcgatgcgtactggtcgagcgagcccgacggcgggatgccgacgtggtagtagccttgccggcccatgtcctggaccgacgtcgcgaggccgggtttcacgacctcgatcaggttgtgcgcgtcagcttgcatgcagcacctcgacgagagagcggttgtacgcatcgggatcgcgcaggaatgcgtcgagcgagaatttcaccgggcgcacgcgcagggaaaggtgccggcctcgacgtcggccaccgcggcgtcgtaggtcacgcgatcgatcggctggaatttcacgatgtcgccgggccggaagaacaccatgaactcgcgcaggtagtcgagccgctgcgcgggtcgaagatcggcgccggcgtcacgccgaacatctggtagccgcccgcgccgcgtaccgagtagatgcagccgaaacagccgccgtggcccacggtgagcttcggcgtgtcggtgcgcggccgcaggtatttcggcacttcgagctggcgttcgcgctcgaccatctggtacatgaacggcaggcccgcgacgaagccgaccatcgacacgaaccatggcgaccccgagtgcgcggcgatgaaggcatcgacgtcgcgcttgccgttgatgcgcgccgcgtattcgagatcggtcgacgacggatcctggtggcgttcgcgaaaccgcatcagcgtctcgtgcgtccatgggtcgttgtacagcactggcacctcgacgatgcgcgtatcgagttcgagtggcgcgtcgccgacttcggcctcgatcgtcttcaacagcgcgacaagcgcatcgggctcgatcacgtccgggtcgtagcgcacctggtaggacgcattcgccggacagatctcggtgatgcccggcaccgcgcggcgctgcagttcgcgcgtgatcgccgtgcccttgaagaatgcgtcgagcgacatcgattcgctgatttcgacgaacacgaattcgtcgccgccgaaggtataactggtcgtcacatcgcctccccgacgcgcacggcgtctgcatgttcggctgcgtgttgctgcgtggcggctgttgcggcctcacgccattgcggcatccacgcttcgaggaaattcgtgtgatagtgcccggcgcgtacgtcgtcgtcggcgagcagcgcgacgtgcagcggcgcggtcgtcttcaggccgccgacgtgcagctcgcccagcgcgcgggccaggcgctgcagcgcggccgcacggctctcgtcgtgcacgatcagcttcgcgagcagcgaatcgtagaacggcggcacgacgtagcccggatagagcagcgaatcgacgcgcacgccggggccggtcggccacaccagtgtgtcgatccggccggggctcgggcggaaatcctgcaacggatcttccgcgttgatccggcattcgagcgccgcgccgcgcatcgcgatgtcctgctgcgcgaagcgcagcggctcgccgtcggcgatgcgcagcgtctcgcgcacgagatcgatgccggtgatcgcctcggtcaccggatgctcgacctggatgcgcgtgttcatctcgatgaagtagaactcgccgcgcgcgtcatcgaacaggtattcgagcgtgcccgcgctgcgatagccgaccgcctgcgcgagccgcgtggccgacgcgcacagtgcgtcgcgctgcgcgggcgtgagcgaaggcgacggcgcttcctcgaggattttctggcgccgccgctgcagcgagcattcgcgctcgaacaggtggacgacgtgacggccgtcgccgagcacctgcacctcgatgtggcgcgcccgcgtgatgaagcgttcgaggtacacgccgccgtcgccgaacgccgcctgcgcctcgcgctgcgcgagcggcagctcggcgtcgagctgcgcggcgtcatgcgcgacgcggatgccgcgcccgccgccgccggcggccgccttgatcatgatcgggtagccgatgcgcgcggcgacgtcccgcgcctcgtcgagcgactgcacgacgccgtcgctgccgggcacggtcggcacgttggcgcgccgcgcggtttcgcgtgcgcgggccttgtcgcccatcgtggcgatcacctgcgagtccgggccgacgaagatcaggccggccgcctcgacctgcgcggcgaaggcggcattttcggacaggaagccgtagccgggatggatcgcgtccgcgccgcactgccgcgcggcgtcgaggatcgcggcgggattcaggtagctcttcgccgcgtgtgacgagccgatgtggacggcttcgtcggccatgcgcgcggcgaggctgtcgcggtccgcgtcgctgaccacggcgaccgcacgcatgcctagctcgcgcgcggcacggatcacgcgcaccgcgatctcgccgcggttcgcgaccagcactgtacggatgcgcgacggccggtagaacgcgctggaggaggttgccggattcatcgcatcaccctcgatccgcatcagcacctggcccgcgtcgactggctcgccgtcctcgacgagcagttcgacaacgcgccctgccgcatcggtttcgatctcggtgaactgcttcatcacctcgacgaggccgaccaccgcgccggcggcgaccgtcgcatcgaccgcgacgtagtagtccgcatcgggcgacggacgccggtagaaggtgcccggcagcgggctgacgatatcgtgcaatgccatcgtgtgtctccttgaatcagtgatgggcggcgagcggttgcggcccggcggtccggatgccttcgcggatcagcgcgtggcgcgtttcgcgcacgaggtcgagcgcgcccggcgtgtcgctgtggatgcagaccgaatcgaaatcgatgtcgatgtcgtcgccatcgatcgtccgcaccttgccgtcgatgcacgcgcgcagcaccttgtcggcgacctggcgcggatcgaggcggccgacgcggcgcgtgaacacgatcgagccgctgcggtcgtagtcgcgatctgcgtagaactcacggacgaccggctgcccgtactcgacggcgacgcggtacgtgaccgacgcctccatgcagtacagccacaggcccggatcgacgcgttgcagcgtttcgatcagcatccgcgagaacgcttcgttgcctgccgcatgcatgtagagcgcgccgtgcggcttcacgtgctgcaggctgacgccgttcaggcgcgcgaactcgcgcagtgcgccgagctggtacaggatgtcgttgacgagcgcctgcggcgtttcggcgatcgtgcggcggccgaagccgacgagatcgcgaaagcccgggtgcgcgccgatgccgacgccggcgtcgcgcgcgagctgcaccgtgcgcgccatgatgttcggatcgccggcgtgaaaaccggtggcgatgtttgccgagctgatcagcggcatgatctgctcgtcgacgccgtcgccgatcgtccacgggccgaagccttctcccatgtcggagttcaggtcgacgctgtgcttcctcatacgatgtgctcctcctggttctccggttcgcgtgcgtcgtggcgcatgccaaaaccgtgttgaacgcaggttagccgcgtggggtgcgtcaaaaagttctatttttatatgcgaccgtatcgatttttcgataccgtggaaaacggctgccaggtgccgccgcagcaggaacggcagggtttccacgaggtctggttcatgggcacggcacggttgttatgatgtttgtcgcgtgcccatctgttttctcatcgaccatggccctgaccctcagacagctcaagtatttcgtcgcgaccgccgagctcggccagatctcgcaggccgcgatccagctcacgatttcgcagtcggccgtgacgagcgcgatcagggaactggaggacagcctcggcacgcaactgttcctgcgcacgccgtcgggtgtgacgctcaccgacacggggcggcgcttcctgaatcacgcgtacacgatcctgtcgtcggttgacgaggcgatgcggattccgaacctcgaaagcacactggccggcacgctcgcgatcgccgcgagctacacggtgctcggctatttcctgccgcaccacgtgctgcgcctgaacacgctgtatccgcggctgacgatccacctgcacgagctgaaccgcgagtcgatcgaggaagggctgatcgcgggccgctacgacatggccgtgctgctcacgtcgaacgtgtcgaatccggcgctcgtgctggagccggtgattcactcggtgcggcggctgtgggtcggcgcgcatcatccgctgctcaggcacgagagcgtcacgttcgcggaagtcgcgcgcgagccgttcgtgatgctgacggtcgacgaggcggggcagacggcgctgcgttactggaacgagacgccgtaccggccgaacgtgatcctgcgcacgtcgtcggtcgaggcggtccgcagcatggtcgcgaatggcagcggcgtcgcgatcctgtccgacatggtgtatcggccgtggtcgctcgaagggcggcgcatcgagacgatcgtgctgcgcgatgcggtgccgccgatgagcgtcggtcttgcttggcgcaaggacatcgagttgagcccgcgatgcacgcggtgcgcgattatttccggcacacgttcatggagccgcgcgcgctcggcggcgcggcctgaacgacggggcggatacggaaaagccggggcatccccggcttttccgtttgcagatccggcccgacggccgctccgcttacgcgttcgccgacatcgcgtccgcgtcgctcgcgcggatgccgaggcgctcgaacagcgcgcgatccttctgcgattgcgggttgctcgtcgtcagcagctggtcgccgtagaacatcgagttcgcgccggcgaggaagcacatcgcctgcagcccgtcgtcgagctgttcgcggccggccgacaggcgcacgacggccttcggcatcgtgatccgcgcgaccgcgatcgtgcgcacgaattcgaacgggtcgagcggcgcggtgccttcgagcggcgtgccttcgattgcgacgaggttgttgatcggcaccgaatccggatacgggttcaggttcgcgagctgcgagatcaggcccgcgcgttcgcggcgcgattcgcccatcccgatgatgccgccgcagcacacgttgatgccggcgtcgcgcacgcggtcgagcgtgtcgaggcgatcctggtaggtacgcgtcgagatcacctggccgtagaactccggcgacgtgtcgaggttgtggttgtagtagtcgaggcccgcattcgcgagttcctgcgcctgttcgtcttccagcatgccgagcgtcatgcaggtctcgaggccgagttccttcacgccgcgcaccatctcggtcagcgccggcatgtggcgctccttcgggttgcgccacgcggcgcccatgcagaagcggctcgcgccgttcgccttcgccgcgcgggcggcatccagcaccgcgtcgacgtccatcagcttctcggccttcaggcccgtgtcgtggtgcgacgactgcgagcagtagccgcaatcttcctcgcagccgcccgtcttgatcgacagcagcgtcgacagctgcaccgcgttcgcgtcgaagtgctcgcggtgcacctgctgcgcgcggaagatcaggtcgttgaacggcagctcgaacagcgcgacgacgtcggcgacgcgccagcgttgcgaggccggagcggccacgggaatcgcgtcgggttgcacggtggcggcggtctgggcttgggtcatatcgttttcctgtcctggtcggggatgagggatcggggatctgtttctgtcgggtcaatgccgcgcggcgcgcagcgtatcgacgagcgcggcgatgtcgagcatcgccgcggcggattcggggcggccgggctcatgtgcggaatgcggccgagcagcggcgcgccgtgctcgcgggcgagccagtcgcgcatcgtcgcgacgttctcgtcggggaacgacatcgccgggtcgacgtggtttgcgacccagccggcgagcttgaggccgcgttggcgaatcgcgtcggcggtgagcagcgcatggctgatgcagccgagccgcacgccgacgacgagcacgaccggcacgccgagcgcgaccgcgagatcggccatgtcctgcgtgtcgttcatcggcacgcggaagccgccggcgccttcgacgacgacgatatccgcgcgcgtcagcgcttcgcgatggcacgcgacgatcgtgtcgatgtcgagcgtcacgccttcccgcgcggcgacgatatgcggcgcggccggtgccttcagcaggaacggcgtgcgcagctcgggcggcagcacgacgttcgcggccgcgtcgagctggtcggcatcctcgttgcgccacacgccgtcgcgttcatatgcgccggccgcgacgggtttcagcgcggcggcacgcaggccgtgccgcgcgaagccgtgcagcatcgcggccgacacgaaggtcttgccgatttcggtgtcggtgcccgtgacgaaaagcgagagcggggcggtcatgccgcgacctcccgcggggccgcgtcagcggaggctgcggctccctcgctggcttcgaccagcgcggcttcgagccgcgcgagatcgtcgaacgaatgcgcggccgacagcgacacgcgcagccgcgacgtgccgacgggcaccgtcggcggccggatcgcgggcacccacaggccgtgcgcgtcgagcgcgcgcatcgccgcgagcgtcgcgtcgttgctgccgatcacgagcggctgcacggccgtgtgcgaatcgaccggctcccagcgcgtattgcgcagcagcgcgcgcgtgcgttcgatcagcgcggcgagatgcgcgcgccgcgcatcgccttcgtcgcccgcgatcaccttcaggctcgcggataccgcgtgcgcgacggccggcggcgcggccgtcgtgaagatgtagctgcgcgcgcgctggatcatccattcgattaccgtctcgtgcgcgatcacgaatgcgcccgcgacgccggcggccttgccgagcgtgccgacgtacacgagatgcggcgaacgcagcgcggcggccgcgagcgcgccgcggccctgcgggccgagcacgccgaagccgtgtgcgtcgtcgacgacgagccacgcgccatggcgctcggccagcgcgacgagttcggcgagcggcgcgatgtcgccgtccatgctgaacacggtgtcgctgacgatcagcttcgtttcggcatccgacgcgtcgagcagcgcggcgagcgcggccgtgtccgcgtgcggatagacctgtacgttcgcgcgcgacagccgcatgccgtcgatcagcgacgcgtggttcagcgcgtcggagaagacggtggcgcgcttgccggtgagcgccgtcatcgcggcgaggttcgccatgtagccggtgctgaagtacagcgcgcgcggcgcgtcggagaagccgcccgagaaggccgcgagttcctcttcgagcgtcgcgtgcgcgcgcgaatggccgccgagcaggtgcgagccgccgctgccggcgccgtagcgctgcgcgccttcggcgaacgcggcgacgagcgccggatgcgcggcgaggccgagatagtcgttgctggcgaagccgacgatctcgcggccgtcgacggtcatgcgcgcgtcgcacgcggtgtcggcggtgcggcgcacgcggcgcagccctgggcgtcgaggtcggcgaggccgcgttgcagcgcgtcgagcagcgggtgcgtcatcgtgcgatctccgcgagcgtggcgtcgagcgtgtcgcgcgtgcgttgcgcgagccacgcgatgtcgtcgtcgctcatcacgtacggcggcatcaggtacacggtcgtgccgatcgggcgcagcagcagctcgcgttccagcgcgcgttcgaagaagcgtcgcgagaagccgcgcgccgcatcgccgtcgagcgcgacgtcgaacgcgaacagcgtgccgcgctcgcgcaggtggcgtacctgcggatgtgcgtcgagcggcgcgagcgcggcacccagcgtggccgacttgcgcgcgttcgccgcgagcacgtcgtcgcgtgcgaagaggtcgagcgtcgcgaccgccgcgcggcacgcgagcgggttgccggtgtacgagtgcgagtgcaggaagccgcgcgtcgtgtcgtcgtcgtagaacgcggcgaacacgtcgtcgcgcgtgagcacgagcgacagcggcaggtagccgccgctgatgcctttcgacaggcacaggaaatcgggccagacgccggcctgctcgcacgcgaagaaggtgccggtgcggccgcagccgaccgcgatctcgtcggcgatcaggtgcacgccgaattcgtcgcacagcgcgcgcagcccgcgcacgtacgacggatcgtgcatcgccatgccggccgcgcactgcacgagcggctcgacgatcagcgcggcgatccggtcgccgcgctcgacgaacaggcgccgcacgtccgcgagcgcgcggcctgcgacgtcggcggccgtttcgcccggcagcgcgccgcgcgcgtcgggcgacgcgacgacgtgcgcatggcggatcagcggatcgtacgcgtccttgaacagcgcgacgtcggtcacgccgagcgcgccgatcgtttcgccgtgatagctgttcgctacgcagacgaattcctgcttgttcgcgcggccgcggttgcgccacgcgtggaagctcatcttcagcgcgatctcgacggccgacgcgccgtccgacgcgaagaacgcgtggccgagcgtgcgcgcggtgagcgcgtgcagccgctccgcgagctcgatcgcgggctcgtgcgtgcagccggcgagcatcgcgtgctcgagcgtgtcgagctggtccttcagcgccgcgttgatgtccgggttcgcatggccgaacaggttcacccaccacgagctgatcgcgtcgaaatagcggcggccgtcacggtcgtacagccacacgcccgcgccacgcgcgacggggatgagcggcaggcgctcgtggtgcttcatctgggtgcagggatgccagaccgcgcgcaggctgcgcgcgacccagtcgtcggtggctggcgtactcaaggcggctccggggataaaacggccgcgcggcatcgacgggatgccgcgcggcaggacagcgaaacgcgctgagattagcgtgttccgcgacgggttgcactaccggttacaaaggccgcggagccttgctggacgggagttcggcgcagatcggagcggctcgggacggtacggttcagaagtccggaaatgaccgcagatgacgacgttcgagtgagacccccaaccgaaaaaaatcggggtcgggcggtgcggcaggggaaaaatcggggagcgaaggggcgaatcgggtgggtgttgtggccccaacgtgaccggaaggcgaatgactgaaagcggtgacgagggcgcgctcgggccggcaaacgatgcgaacggcggacgcggcatccgacgcaaacgcggcatgcagcgtgtgcgtgaagcgatgaaaacggggaaaggaaaagcgaaacggggcagcgaaggccgccgcccgtcagcgcgaagccagcgcgcgcgtatcgatatcgcgtgtcgtattggcgtcgctgttgtcggccgtctgcgtgttcgtgttccacacgacccggtcgttgaccgcatacagccggcacgcgcccgcgccctgcttcgcgcagttgtcgagcgcgagcgccatcgggtcgtcgccgccttcggcccacgaccacgcgccttccgacgacaccgcgaacgcgcggctcggatgctggttcaggaagcggcgatagccttcacggccggcttcgtcgacgtacggcaccgcgttgaccgcatcgatcgacgcgtagccggtggctttcggctcgtgcgggttcgcgaccgcgtagcgcaccgaggtcggcaggttcagctgcgcgaggaacgcgttgacggccggccaccacacgggcacgccgtcgcgatcgacgatcagccggtgcgcgtcgtccttgtagcggccgaaatcgatgaactgggcctgcgtgccgtgcgacacgtacgcgtcgtgcatttgcgcgacgagcccgggcgtccacaccgaatcgttgtcgccgtacagccacagcgaccgcacggccgtgtgcgcgccgtactggtcgaacgcgtcgacgaggttgcgctgccagccgtcgcagaggtcctggcgcagcccgccggagaagttgatgatgccgcgcacgcccggtgcggcttcggtgccgtacgcgaccgatacgaggccgccgtgcgacgtgccggcgacgacgatgcgcgacgcatcgacatacggctggcgcgacatgtagcgcaccgtcgcgtcgacgtcggccgcctgcgcgaggccgttcttgccgacgttgcagccttcctgctggtacgtgccgtccgagcccgcgaagccctgacggttcggcgcgatcaccgcataaccgcggcgcacgaattcgcgcgcgaacgcgagcggccggctgcgcggctgcagatggagatcgccggtgttcttgccgtggttgaagacgacgagcgggaacgggccggggccgttcggcttgaagagcgtcgcctcgagcgtgacggtgcccgatgcgtcggccggaatgcggaggatctgttcgttcaggtcggcggcgacctgcggcaggttcgaatcgccgtagtcgaagcgttcggcatgggcgagcgacccgctggcgccggcgcccgtccccgtattggcgttcgacagcgtaccggcctgagcggccgacagcgcgcaggccgccatccatcccaccaataccttgctgaacgccattcgtaagccctgccatgcaacatgactgatctgagggccatcctagcccgacaaattcaggttgtgcaatgcgggaattacccggcgtctgacacagcaactatttgtcaacgttcacttacttcgccgtcgacgtaacgccagaaaccgtgctcgtcgcgctcgaagcggctcgtctcgtggagccggtaagcgcgtccgccgatcttgtagcgggccacgaattcgacctccgcgtgccgttcgtcgagcggcgcgtggcgtttgaccgcgaggccgagccagcgcggcgcgtcgggcgcttcggggtcggtgtcgagatcgggcgggcaggtgcgcgcggcccacgtcgcgcgcaggtagtcggtcgcgccgagcacgtacgcgctgtaccgcgaacgcatcaactcgagtgcgctcggcgcggcttcgccgccgtcgatgaagcggccgcagcaggccgcgtagcgggcgccggcgctttgccggcgggagcggggacgcgccgccgcacgggcacgcgtcaggtcggttcaaaatcatgcgaaacgggaattaacgacgtctggttgtcggctgactaccggctgactaccagctcagctcgatgccgtcgtactggaagaaacggccgtttgcctgcgacacgtccgcgccggattcggcgatcacgcggcgcatgccggtcacgctggtttccggatcgatcgcggcctgtgcgccgcccatgtcggtgcgcacccagccgggatggagcgagatgcacgcggcgtggcgcgtctgcagcgacgcgatgcgcagcacgtcgttcagcgcggccttgctcgcgcggtacagccagccggtcgtgccggtcgcctcggcgatgctgcccatccggctcgacacgacggcgagcacgccgcgtgcgtcctcgacgagcggcagcaggatcggcagcagctgcatcggcccgcgcacgttcgtatgcatcaccgcgtcgaaatcctcggcggtgatcgtctcgacgccctcggtgcggggcccgtagacgcccgacaccagcacggccgcatcgagccgctcgccgtcgagcttccagccgagcgccgcgatctgctcgggctgcgtgatgtcgagcgcgtgtgcttgcgcgccgagcgcgcgcagcgcgtcgagcgaggcatcgtcgcgcgcggtggcgatcacgttccagccgtcgcgccggtattgccggacgaattcgcggccgaggccgcgcgatgcaccgacgatcaatgcggttttcatgcccgtcgctcctttgcttggcgccgccctggcggtaccggtgtcagatccgttcgatgcggggcgcggccgcgtggcaacggccgcccggcggcttgcgcgttacttcgcgtcgtcgcacggcttcagcgtgtcggcgaccgcctgcgcgacgccttcgagccgccgcgcggcgtccgccgcgatcatgtcgttgtccggcgcatggttgccgccggcggtgagcgcggccacgcagcgcttgtaggtctcgtcgagcgcgtcgaagttcgacacggccatcccgaggttgcgcatccggccgtcgtgcacgccgtacacgagcccgtgcacggtgagcgactggccgcgggcccacgcgtcgttgacgatcgtcgtgcggcatacgttgacgacctgctcgatcgcgttcagctcgatcaggcggcgatagcgcgcttcgccgaccggccagtcctcgagcagcgccgcgtgacgctcgcgcacgtcctgcacgtgatgcagccagttgtccgcgaggccgacgcggcggttgagcagcgcggcattcacgcccgagcagccgtagtggccgacgaccatgatgtgcttcacgcgcaggatgtcgaccgcgaactggatcaccgacaggcagttcaggtcgctgtgcacgaccacgttcgcgatgttgcgatggacgaacacttcgcccggcggcaggccgatgatctggttcgcgggcacgcgcgaatccgagcagccgatccacaggtattccggcgcctgctggtcggcgagacgcgcgaagaactgcggatcgtcttcgagcttgcgtttgacccacgcttcgttgttgtcgaacaggtgagaaagcggattgtcttgggtgttcatcggtgtggcttccgttgacggaaaacgggtcggtatcggtatcgggttcggtgtaaccggcgtcaggcggcgcgctgcgcgtcgccttcgccgtcgttctggtccgtcgcgccgaagcgctcggggtagcgcacgctgaagcgcagcgatgcgtcgtagggataaaaatcgggcaattcgccctgcagcagcttgtccttgctggcctgccacagcgcgggatcgaaaaagtccgcgtgatgcttcatgaagacgtcgcgcacgcgcgggtcgccgagcaggaacggcccgtaggtctccggaaagatgtcgtgcgggccgacggtaccacggttcgccggacagctcgtcttcctcgttgcgcggcggcggtacgcggcgcacgttgcagtcggtcaggtactcgatctcgtcgtagtcgtagaacacgacgcggccgtggcgcgtgacgccgaagttcttgtacagcatgtcgccggggaagatgttcgccttcatcagctccttcaccgcgttgccgtactccttcacgccgtgctcgatgtcggtatcgctgccgttctgcaggtataggttcagcggcgtcatccggcgctcgatgtacaggtgcttgatcacgaggttgtcgtcctcgtattcgagcagcgacggcacttccttttccagctcgcgcacgagcgcgtggtcgagccgcgcgagcggcagcgcgacgctcgaatactcgagcgtatccgccatccgcccgaggcggtcgtggcgcttcacgagctggtacttctccatgatctgcgcacgcgtcgtttccttcggcggcgggaagtgatccttgatgatcttgaacacgtacgggaacgacggcagcgtgaacacgagcatcacgaggcccttgatcccgggcgcgatgatgaagcggtcgctcgaatgcgacagatggtgcagcaggtcgcggtagaacaggttcttgccctgcttctgcaggccgaccgacgtgtagatctccgccttcggcttgccgggcatgatcgtgcacaggaagtcgacgtacgcggacggcacgcccatgtcgaccaggaaatacgagtgcgagaagccgaagatgatcatcagctggtcgcggcgcagcagcacggtgtcgagcgagagcacgcccggacgcacgtggcggatcggcaccgcgaacggcagcacgcggtcggcgttgatgatgcggccgacgatgtacgcgctcttgttgcggaagaacagcgacgacagcacgtggatctggaaattcggcgcttcgtcgaagtggccgaattcgtcgtggatcgcctgcatcacgcagccgatgtcgcgcgggagatcgtcgaacgccggctcgagctggaagttcgtgacgatgcgctcgagggtggccgcgagcccgtcggtgcccggatagtacgcgcggtaggtcggcttcgcggccggctcgtcgttctcgagatactcggtcgagatcgccgggcgcacgaagatgaaatcgttgctgaagtacgagcggtgcaggatcttgcagcacaccgaattgaaaaacgtctccgcgcactcgggctggcggtgcgacgtgagcaggccgatatagtgcagcttgatctgctgccacacttcgtcgtcgatgttttccgcgtcgtattcgtcttccagcacctcgacgcattccttcacgcgatcgtcgtacgacgtgatccgctcccgcgcgagccgctgcagcccgtgccagtcgccgtgctcgaacagcgtcttcgcttcgacggccgcgtcgcggaagatccggtagtggcggtcgaagttttcgagcatcgtctgcgcgacgtcgaaaccgatctgcgaagacagcagtttgggaagtgattcattgcgtgcaggctcgttcgggaggggctgtaagcactcgccattttagcgcccaagtcggcgtttcaatgactttcggggtgacgcgcccacggccttcaatcggcgcgttgttcgccgttgcgtgccgttcggtgcatcttcgcgtaaagatacgggtacggaaccgattctggcacgaacttttttgacggggcggccgccgccgggcacgcgtcgagcgcgacggcgatagaatcgacgcgacgcccgccgcggcctgccgccggcgcgcattcgcaccgataacgacgagacgccccaccgatgaacgcactggaacaccaactcgactaccccttcgccgacacgctgcccgccgcgggcgacacgttcgaggtcgcgcccggcgtgcgctggctgcgcatgccgctgccgttctcgctcgatcacatcaacctctggctgctgcgcgacgagatcgacgggcaggccggctggacgatcgtcgattgcgggatctcgtcggacgcgatccgcacgcactgggagcagatcttcgacacgcatctcgacggcctgcccgtgctgcgggtgctcgtcacgcactgccaccccgatcacttcggcctcgcgaactggctgtgcgaaggcggcgacaagggccgctggaacgtgcggctgtggatgacgctcggcgagtacctgttcggctgcctgatggcggccggcaacggctcgaacgcgggcggcgcggcggccgccgatcacttcgcgcgccacgggctcaccgatccggccgcgctcgacaagctgcgcaaccgtcgcaactactactcggatctcgtgccggccgtgccgccgcgctaccggcgcctgcgtgaaggcgatgcggtgacgatcggcgcgcgcacctggcgcgtcgtgaccggcttcggccattcgcctgaacattgcgcgctgcatagcgaagcggacggcgtgctgatctccggcgacatggtgctgccgcgcatctcgacgaacgtgtccgtgttcgacctcgaaccggaggcgaatccgctcgcgctgtacctgcagtcgctcggccgttacgagacgatggcgcccgatacgctggtgctgccgtcgcacggcaagccgttccgcggcgtgcgcacgcgcatcgcgcaactgcgcgaacaccatgacgcgcgcctggccgaagtgcgcgtcgcatgcgcggaaaagccgatgagcgcggccgacatcgtgccgatcatgttccgccgccgcgaactcgacatccaccagatgacgttcgcgctcggcgaggcgctcgcgcacctgaacctgctgtggctcgcgggcgaactcgtgcgcgagcagggcgacgacggcgtgctgcggttccgcagcgccggctgacaccgcttcgttctcctcatgcgacgggttcgtagcgccacccgtcgcgatgccactgcatcgtgtgcgtcgggtcgagcgccgcgagaaacgcggtgtcgtgcgaggcgaccacgatcgcaccggggaagccggccagtgaggcctcgatcgcgcgcaccgattcgagatcgaggtggttggtcggctcgtcgagcagcagcagttgcgcgggcgtgccgcgccacaacgcgcatgcgagcgcggccttcagccgttcgccgccgctcgctgacgcgccggctgcgtcgcgcgcgccgcatcgagttgcagcagcgcgagccggctgcgcagttcgccttcggcgagcggcgtatcgagcagcccaagttgttcgacgatcgagcgctccggatcgagcagcgcgagccgctggtcgagatacgcggcgctcacgtgcgtcgtgcaggtgcccgagcatggcgcgagctcgcccgcgagcatccgcagcagcgtcgatttcccgcagccgttggggcccgtcagcgcgatgcgcacggggccgctcgccgaccacgtgaccccatcggcggcgccggcgatgccccacggcagtcgcgcgcgttcgagcgtgaacagctggcggcgtgcgctgacctcggtgcccggcagcgacaccagcacgggcgcatcggcttcgacgcgcgcggccgcctgctgcacgcgttcgtcgagcgtcgccttgaagtcgttctggtggcgccggacctgccccatgatgttgcgcgccgcgcccttgcggctttgtttcgcgcccgacgacaggttggccgtcttcgcatcgcgcagcgacgcggccgcgtggcgctggatcgtgtcgtgttcctgttcgagcctgcgcctcgcgcgtccgcgttcggcacgcgcgttgtcgagcgccgcttgcgcggcatcctgatccgcgtcgcgctgcgcgcggtagaacgcgtagttgccgccgtacgagcgcacgccttgtggcgtcagctcgacgatgcgctgcacatcggcgagcagcgcacggtcgtggctcacgatgacgaggccgccgcgccagccgtcgagtgccgcgcgcagccacgcgcggcccggcgcgtcgaggtggttggtcggttcgtcgagcacgagcaggccggcaccggacagcaacgcaccgatcagcgcgacgcgtgcgcgctgcccgccgctgagcgcctgcgcgggcgtgtcggcgcgcacgtcgtgcaggccggccgcgtcgagcgcggtgcgcagccgttccgcgagatcccagcgatcgccgatcaggtcgaagtcgtgcggctccgcgcggccatcggcgaggcgcgcgagtgcgccgagcggcgcatcgagcgcggcgagctgcgcgacggttcgcgggccggcggcggcatcgtcgtgctgctgcgcgacgtaggcgacctgcgtcgaccggtcgatcgtccccgcgctcggcgcgcagcggcccgcgatcagttgcgcgagctggctcttgccgacgccgttgcggccgacgatgccggtcggcgtgcggtcgatggaaaggtcgagcgaatcgaacagcgtgacgccgtcgtcgaagcggaaggaaacgtgatgaagcgcgacgagcgcgccggtgggcgtggcagcagccataagcacctccgaaaatgcgtgaagaccttcgcgcgcggcgtgcgtggcacggcggcgaaaacattttgggaaggcttagttgttcactttggctggcgtccggtatgaggaatgagcgcgcagtgtagcaagcgcggcgcgcgggccgcaagcgacggcccgacgcaccgtcgcttgcgtgccacgcgcgaggggcgcgttactgcacggcgaccgtcgtgaagttctgccgcccgaacgggcttacgtggtagccgcttacgctcgtacgcgtgagcgcggccgcggtcgggtagccgagcggaatccacagtgcctggtcgtggatgatcttctgcgcggcttcgtacagcttcgcgcgcctggcctggtcggcggtcgacttgccgtcggcgatcagcttgtcgagctgcgcgtcgcagaaacgcgcgaagttgatgcccgacttcaccgcgttgcagctgaacagcggcgacaggtagttgtccggatcgccgttgtcgccggcccagcccatgaacagcatgtcatgctggccgagcttcgcctgcttgatcagttcgccccattcgatcaccttgacctcggccttcacgccgatcttcgcgagatcggcctgcagcagctcggcgccgaccttcgggttcgggttcagcacgctgccggtcgggcgcgtccagatcgtcgtcgagaagccgttcgggaagccggcctgcgcgagcagctgcttcgctttcgcgggatcgtacgcatacggcgcgacgtccttcgcgtagctccacgtattcggcggatacgggttgttcgcggccgtcgcggtgttgtcgaacacgaccttcaggtaggtcgcgcggtcgaacgcgaggttcagcgcttcacgcaccttgtcgttgtcgagcggcttcttctgcgtgttcagcgcgacgaacgcggtcatgaacgcgggcgtctgcacgaccttcagcgcgttgtcgcccttcgcggcgagcacgtcctgcggcttcggcgacagcgcgatctggcattcgccggccttcactttctgcaggcgcaccgacgggtcgggcgtgatcgcgtagatcagccggtcgaccttcggcttcgtgccccagtacgtcggattcgcgtcataacggatcagcgcgtccttcgtatagctcttcagcacgaacgggccggtgccgaccggcttcgcgttcaggtcggcctgcttgccggccttcagcagctggtccgcgtattcggccgagtagatcgacgcgaagcccatcgtcaggatcggcacgaacgtcgcgttcggttcgttcagcacgaacttcacggtgctgtcgtcgaccttcgtgaccgatttcacgagcttcacgaggcccatcgactgcgcgtgcgggaagccgctcgcgccggccaccttgtgccacgggttcgaatcgtcgagcatccgcgagaacgtgaacacgacgtcgtccgcgttcagcgcgcggcccggcttgaaatagtcggtggtctggaacgcgacgttcgggcgcaggtggaacgtgtacgtgaggccgtcggcgctcgcttcccatttgtcggcgagcgcgggcacgaccttcttcgcggcttcgtcgtacgacacgagcgtgttgaagatcacgtcggccgacgcgttggtcgtgacgagcgagttgtactgcacgacgtcgaagccgtccgggctcgattccgtgcagacggtgagcggcttggcggcggcgaggccgggggcggcgagggcggcggcgagcgcggccgcggcgaacagcttgacctgcataggatctcccacgtggcttgtgtttttgctgggtgacgggatgcgggcgcggcccggaagcgggcagggccggcgcggctggcgaatagcataccgtcaaagcgcgcgacgcgtggaaaaaggcgcctgaacgcggtgaattgaccgaaaaacggctgcgttcgcgacggaacgggtgttggggcggcgagcggtggagcgcaggcgacggggaggccgggcagcggcacggtgaggacggcgcggaagcgttgcgggctggccccgcgattcgaggtgtcgaagccgttaggcgtcggtgcggagaggcggagaggcggagaggcggagaggcggagaggcggagaggcggagaggcggagaggcggagaggcggagaggcggagaggcggagaggcggagaggcggagaggcggagaggcggagaggcggagaggcggagaagcggagaagcggagaagcggcccgcgatgcgtcacgcgggccgttgggccgatcagtgcgcgccggccttcggcttgcgcggcgccttctcgaacaggcggtcgtagagccagcgcggcagcacgtgcagcaccttcgcgacgacacccatctgccacggaatcacgcggaacgcgtgctgccgcgcgatcacccgggccgcacgcgcggcgaagcggtcggcgtccatcaggaacggcatccggtacggattgtgcgcggtcatcggcgtgcggatgtagccgggcgcgatcgtcacgacgccgacgccggccggccgcagctcgacgcgcagcgcttcgaggtacttcatcgcggccgatttcgacgcgctgtacgcgccggagcccggcagcccgcgcacgccggcgacgctcgcgacaccgaccagcgtgccgtggcgcgcggccgtcatcgggccgacgaacggctcgaacgtcgcgaccatcccgtagtagttgatgtccatcacgtcgcggaacgtcgcgagatcgccctggcccgtgacggcgccctggctgatgccggcattcgcgatcacgacgtcggggcatccgtgcgtcgcgatgaacgacgcggcggccgtcgcgagcgcgtcggcgtcgcgcacgtcggcggagtagacggagatggacagcttcgggaagcgtcgcgcgaacgcgtcgagggcatcggtgcgtcgcgcgacgagtgcgagcgtggcgccctggcgggcgtattcctcggccatcgcgaggccgaggccgctcgatgcgccggtgatgaagaccttcagcggagtagtcatgccggcgcgcgggcggggatcagagcttcttgtcctgaacctgcttcacgaggaagtcgagcacctgggcggtacccgggatgctgttcgcgtaagcggggcccgtcttgtacttgccctggacgacgaccgtcggcacgccgtcgatcgcgtagtccttcagcagcttggccgactggttcacttcgccctgcacgctgaacgagttgtacgcgtccatgaactgcttcttgtcgacgccctgcgtggccaggaagtcggcctgcgcctgcggcgtcagcaggtagttcttctgcttgtggatcgcgttgaagatcgccggcgtgaccttctcggagatgccgagcgcggacaccgcgtagaacagcttcgagtgcgggacgaaatcgtcacggaatgcgaccgggatgcgcttgaagtcgatgttgctgccctgcttcttcacccaggcctcgatcgtcggctcgaattcgtagcagtgcgggcaaccgtaccagaagaactcgatcacctcgaccttgccggccggcgcggacaccggctgcggcgacttcatcacctcgaagtccttgccggcgaccggcgcggcgggcgaagcctgcgcgaggccggcggccaggcccagggaaagaaggagcgtgctaagcagtttttcatgttgtgaacgtcgaatcagttgctcgggttacggaacgtaacgggttctgagtgggctcggccggttgcttactgcttcgtgaaacggatcaccgccgtgtcgacacctgcatcggacaggcgctggcgggccgagttcatatcctcgaacttcgagaacgggccgacgcgcacgcggaagtacgtcacaccgctgacatcgcgcttcgacaccttcgactcgaagccctggaagccgaggcgcgcgcgctgctgctcggcgtcgccttccgtcttgtacgcgcccacctgcaggaagtagccggtattcgcgtcgttcgcggtcggcggcttcgctgccgcggcggccgtggccgacgaggtcggcttcggcgtgttcgcggccagttgctgctgttgctgcttttgtgcggcggcttgctgcgcctgcttctgcgcggcgaaacgtgcgaggtcgtcctcgccgccttgctgctgctgttgcgcctgttgcgtcttcttcggcggcggcgtggtgtcggccggcttcggcgcgacggcgacgccgttgcccgacgacgcattgttcgacgacgtgttgttcgacgcggtcgtgccgttcgagctgccggtattgttcgagccgctcgacccgttggccgacggcggcacttcgacgatctgcggttcgggcagcaggccgccctgggtctggttcgcggcctggcccggcgcggtgttcggcggtgccggctgcgcggcctgcggcaccggctggccgggcgtcttgccctgcagcgcgcggttcggatcgaactgctgcggctggctcgcgccgttgtcggccggcggcggcgcgaccttcgacacgaacggcgacggggaacgcgtgatgtagagcgccaccaccaccgcgatcgcgaggccgacgatcaggcccagcacgattccaagaaatgtccctccggcttgtttcgattgtttcgaagtgcggcgtggttgtgccattgcttgagtcacctgcaaaagaatcgtgaaaaggctgcggcgggcgtccgacggcgggcatccgacggcgggcgctgccacggccattcgctgcccggttcgggccgcttgcgtcgttacatcttggcgggcgcggacacgccgagcaccgccaggccgttctcgagcacctgccgggtcgcggcgagcagcgcggcgcgcgcattgcgcggcgcttcgtcgtccaccagcacgcgctccgcattgtagaacgagtggaattcaccagcgaggtcgcgcaggtagaacgcgaccgcgtgcggcgccagctcgttcgccgcgtgcgtgagcatgtccgggtactcggccagcttctgcatcagcgacgccgcctgcgcgctcgtcagctgcgacaggtcggcacccggcagctgcgcggcgtcgacgttgtagcgcgccttcagttcgttgagcaccgagcagatccgcgcatgcgcgtactggacgtaatagaccgggttctcgtcgttctgtttcagcgcgaggtcgatgtcgaacacgaactcggtatcggccttgcgcgagatcaggaagaaccgcaccgcgtcgcggccgcgcgtgatggtcgcttcgtcgatcaggtcgggcgccgcttcctggcccgccgccgcgccgcccgaccattcgatcaggtcgcgcaccgtcacgtagctgcctgcgcgcttcgagatcttcacttcctggccgtcgcgcatcacggtgaccatcttgtgcagcacgtagtcggggtagcccttcgggatcccgatgtgcaggccctgcaggccggcgcgcacgcgcgcgatcgtgccgtggtggtccgagccctggatgttgatcaccttcgtgaagccgcgctcccacttcgtcacgtggtacgcgacgtccggcacgaagtacgtgtacgtgccgtccgacttgcgcatcacgcgatccttgtcgtcgccttcgtcggtcgtgcgcagccacagcgcgccgtcctgttcgtaggtcatgccggccttgatcagcgcgtcgaccgtcttctcgacgcggccttcgctgtacagcgacgactcgaggtaatactggtcgaacttcacgccgaacgcccgcaggtccatgtcctgctcgcggcgcaggtacgtgaccgcgaacttgcggatcgcgtcgagatcctcgacgtcgcccgtgcccttgaccggctcgccatccgacgcggcgaccgtttcgcctgccaggaagtcgcgtgcgatgtcggcgatgtattcgccgttgtaagcggcttccggccagcccgcgtcgcccggcttcagcccgcgtgcgcgcgcctgcgtcgagatcgcgaggttgccgatctgcacgcctgcgtcgttgtagtagaactcgcggtgcaccgcgtagccctggctcgcgatcacgttcgcgagcacgtcgccgagcgcggcctggcggccgtggccgacgtgcagcgggccggtcgggttcgccgacacgaattcgagcagcacctgcttgcctttctcgcgatccgacgtgccgaacgcgcggccctggtcgaacacggcggcgatcaccgcctgcttcgcggcggccgacaggcgcaggttgatgaagccggggccggcgatctcggcggcgtcgacgaggccttgcgcgcccggctgggcggtcagggcggcgacgatctgctcggcgagctggcgcgggttcgtgccgagcggcttggcgagctgcatcgcgacgttgcacgcgacgtcgccgtgcgcggcgaccttcgggcgctccagcgtgatggtcggggcgacgaatgcagcgtcggcgcctttcagcgcgtgtgcgacctgcttgacgctatccgcgagcagggcttcgagggtctgtttgtgtgctggcagcatgctggtagaaggcttcgttggtggcggccggaaacgccggcccgccggcgcgcttttaagcgcgcgtttcagggatcgcagaattttaacaggtgctaatatgccgctcaggcggcccgcgtccgcgaggccggacgccggtctgccggcgttccccaacctcgccgcgcaggcacaacaagatgaaaagggaattgtcatgattacgttcaagagcaaggcggcacaggatctcgacgtgctgaaggatttcgccgtgtatgtgctgggtctcgtcggcaagcagctgggcgagcgcggcgtgattacgcacgacgaactggaccacgcgatcgccaagctggaaggcgccgttgcgcaggcgaagcaggagcgcgccgagcatgccggccatttccacgaggacgaagccgaccacgcgcaccacgaagtgccgccgagcctggcacagcgcgtcgcgccgttcctcacgatgctgcgcgaagcgaaagccggcgaagccgacgtgcactggggcttctgagcgtccttgcccggcggttcgaaaggatcgaaaggcagaaaaagcccgcttccgagcgggctttttctttgtctgacgatagcgggcggcggtgcgtccgccgaagggccggtcagagctgcggcgcaagcgcgcggcgcgcgtcgtcgagcgacagcgccatgcgctgcgcgtagtcctcgagctgatcctgtccgattttcccgaccgagaaatacgtgctgtccggatgcgcgagatagaagcccgacacgcttgcggctggcagcatcgccagcgagtcggtcacgctcatgccgatctcgtccgcgtgcagcacgtcgaacatgtcgcgcttcacgaggtggtcggggcaggccgggtagccgggtgccgggcggatgcccgcgtacttttccgcgatcagcgcatcgttgtcgagcgtctcgccgctcgcataaccccacagctcgcgccgcacgcgcgcgtgcatcgcttccgcgaacgcttccgcgaagcggtcggcgagcgccttcagcatgatcgcgctgtagtcgtcgtggtcggcttcgaactgcttctccttcacgtcgacacccaggccggccgtcaccgcgaacatcccgatgtagtcggcgacgcccgattccttcggcgcgatgaagtcggcgagcgagcggttcggccgcatcacgccgtcgaccaccggacgcacgctctgctggcgcaggttgcgccacgtgagcagcacctcgctgcgcgactcgtcgctgtagatctcgatgtcgtcgtcgttgacggtattcgccggcagcagcgagatcacgccgctcgcggtcagccagcgtccctggatcaggcgcgcgagcatcgatttcgcgtcggagaacacgcggcgcgccgattcgccgacgatctcgtcgttcaggatcgccgggtacgggcccgcgagatcccaggtctggaagaacgggccccagtcgatatagttcgcgagctcgttcaggtcgtagttcttgaacacgcggcggccgatgaacttcggcttcaccggctggtagctcgcccagtcgacccgggtcttgttcgcgcgcgcctcggcgagcgtgaccatcggctgcgccttgcggttcgcgtgctggtcgcggatgcgttcgtagtcggacttcagttcgtcgaggtacttcgccgcgccttcgtcggacagcaggctcgatgcgaccgacaccgagcgcgacgcgtcgggcacgtagaccaccgggccttcgtagtgcggcgcgatcttgacggccgtgtgcacgcgcgaggtcgttgcgccgccgatcagcagcgggatcttcttcacgcggaagtagtcgtcgcgctgcatttccgacgcgacgtacgccatttcctcgaggctcggcgtgatgaggcccgacagcccgatgatgtccgcaccctcgaccttcgccttcgcgagaatctcgttgcacgggaccatcacgcccatgttgacgacttcgaagttgttgcactggagcacgaccgacacgatgttcttgccgatgtcgtgcacgtcgcccttcacggtcgcgatgacgatcttgcccttcgcgcgcacgtcgccgcccgcttccgcgagcaggcgcttttcttcctcgatgaacgggatcaggtgcgcgaccgcctgcttcatcacgcgcgccgatttcacgacctgcggcaggaacatcttgccctggccgaacaggtcgccgacgatgttcatcccgtccatcagcgggccttcgatcacgttgatcgggcggccgccggccgcggcgatcttcgcgcggacttcttccgtatcctcgacgatgaagttcgtgatgccgtgcacgagcgcatgcgagagccgcttctcgaccggctggttgcgccactcgaggttctcttccttcttcgcgccgcccgccttgaacttgtcggcgatttcgagcaggcggtcggtcgagtcgtcgcggcggttcaggatcacgtcctcgacgcgctcgcgcagctccgcgtcgagctcggcgtacacgccgagctggcccgcgttcacgatgcccatgtccatccccgcctggatcgcgtggtacaggaacacggtgtggattgcctcgcgcaccgggtcgttgccgcggaacgagaacgacacgttcgacacgccgccgctcacctttgcgtacggcaggttctgcttgatccagcgggtcgcctcgatgaagtcgaccgcgtagttgttgtgctcctcgatgccggtggcgaccgcgaagatgttcgggtcgaagatgatgtcttccggcgggaagccgcactggttcacgagcacatcgtacgagcgcttgcagatctcggtcttgcgcgcgaacgtgtcggcctggccctgctcgtcgaacgccatcacgacggccgcggcgccgtagcggcggatcagcttcgcatgatggacgaacgcctcctcgccttccttcagcgagatcgagttcacgattgccttgccctgcacgcacttcaggcccgcctcgatgacttcccacttcgacgagtcgatcatgatcggcacgcgcgcgatgtccggttccgacgcgatcaggttcaggaagcgcaccatcgccgccttcgaatcgagcatcgcctcgtccatgttgatgtcgatcacctgcgcgccgttctcgacctgctggcgcgcgacggcgagcgcctcgtcgaactggccgttgaggatcatgcgtgcgaacgccttcgagccggtgacgttggtgcgctcaccgacgttgatgaagagcgttccggacgtgacgttgaacggctcgaggccggcgaggcgcatcatgtgatcggtcatggcggtgcgaattctggtgatgaagggcgtggggcggtcgggtcaggcgttgtcgctgtactggttcggccagcggcgcggcttcacgtcggcgagcgccttcgcgatctcggcgatgtgttcgggcgtcgtgccgcagcatccgcccgcgaggttcacgagcccggcttgcgcgaattccttcaggagccccgacgtgacgtccggcgtctcgtcgaagccggtctcggccatcgggttcggcaggcccgcgttcgggtagcacgacacgtaggtgtcgcacagcttcgcgagctcggcgatgtacgggcgcatcagcgccgcgccgagcgcgcagttcaggccgaacgtcagcggctttgcgtgacgcagcgagttccagaacgcctcgacggtctggcccgacaggatccggcccgacgcatcggtgacggtgcccgagatcatgatcggcaggcgctcgccggtgtcctcgaacagttcgtcgagcgcgaacagtgcggccttcgcgttcagcgtgtcgaagatcgtctcgacgaggaacaggtcgacgccgccgtcgagcagcgctttcgcctgctggtagtacgacgcgcgcagctcgtcgaacgtgacgttgcgggcgcccgggtcgttgacgtccggcgagatgctggccgttttcggcgtcggcccgatcgcgcccgcgacgaagcgcggcttgtccggcgtcgcatattttgcggccgcctcgcgcgcgagcttcgccgattcgatgttcatctcgacgacgagatcttccatctcgtagtcggcctgcgcgacggtcgtcgcgccgaacgtgttggtctcgacgatgtcggcgccggccgcgaagtactggtcgtggatctcgcggatgatctgcggctgcgtgatcgacagcagctcgttgttgcccttgatgtcgcgcgggaaatccttgaagcgctcgccgcgatacgcggcttcgtcgagtttgtagcgctggatcatcgtgcccatcgcgccgtcgaggatcaggatgcgcgatttcagcagcgcaggcagagcggcgccgcgcgtgtagtgcgcgtcgagcgggacggaagcggcgagaggagtcgcagacatgggcgaaagaccggcgaagacgggaaaaccgtcattgtagccggtgcgcatgggcgccgcccggccttgcgcggcgccggcggggccgccaatgaaaaccccgcccggcgaaccgggcaggggcatgatcggagtgctcgcggcgccgcgtcgatgcgcggcgaatggcccggccgcgcgaggcgccgggccgcgggtcgtcagtgcagtacgacgggcatcatcatcaggctgtcgaattgtccgaggaattcgtcgacttcatcgagcgacggttcatcttcgatcagctgcttcacgtgtgcgcggaatcgttcggcaagttcgccgtcgatgaagatctcgcgctgtgcgttcttgtcgacgatttcgtatccgccggcattcatcaggtggtggccggcctgcggcgcgaattcgacgacgcagtagttggggctgttgtagatcatttgcatggcggcactcctcttcgcagtggcatctggccttgttgtcccctaggtggggcgagccttgccggtttcaaggggcttgcgctgcacaccccgttcccgtttgcgtggggtgtatcggttagaagccgatgtctatgaaacgtttcccattgtcgaccggtggactgaaatagttgttaaagagtgtcatcggcgatttcacggaaatctgtaatcggtcgaaattgccgaatcacgcgcattcgcgcgcgagttcactgtgtgacaggcgatgtgacaggcgaagatgcgggcggtgcagccggttgtgcagccggtggtgccggcggttgcacggcggcgggcggcgcgggttgtgccggttcggcggccggtgcggccgacggttcgggcgccggtgcagcggcgggcgcatgcgtggcgccgcctgccggtgtctcgtcggacggcgcgcccggcgccgcgagcgggccgtgccacaacagttcgatctgcgcgccgttcggttcggtctgcacgagccgcgcgggcagccagccgagcgacggtgcgagccacatgtcgatgcggcgcgtgtcgccgtcgcgccgcggcaggcgcatgaagtgccgcgcgccgatgatgccggcctgcgtctgcacctgctcgtcgccgatcacggtgatcggccaggtctcgccgctgttgttgtcgatcacgaagaactgctgcgtgacgcccggcttgtacgcggacggattgccgcgcacgagccccgacagctgcatcagcatgctgaagcggtcctgtatgccgtcgggcaacggtgcgttgttcggcgtgcgcgtgaacacgacctgccggatctcgcgattgaagatcgcgatgtcttccggacgcttgccgcgcttctcgacgtaacggtcgggcgcgacgccgaacgcgtcgatgcggccttcgctgcgataggcgaacgggccgacgaacggcacgggcatcgacaccgacaggtcgtaggtgcgcccgtcggtacgccagtggatcgtgccgatcatgttctgcatgccgttgtagaacgtgtcgtactgcaggtcgccggagggcggcgcgatgaacttcacgccgctcgtcgcggggcccggtgtcgtggcgccggcggcgctggcggcacccgcggccgacgcggcgagcgcgcccgaggcgcccggtacgccactcgccgcggacgcggcggccggcggctcgccgtgttcggccgtttgcgtcgacgtgaggaccggcgccggcgcgggtttcggcgcggcggccctggggccgccggggcgggcgcggccggatgctcgaccggcttcggcgctggtggcgcgggctggcgctcgatcggctgcggtttcagcagctcgatctgcacggggatttcggcgggcgcgggcggcgtgaacgcgtcgcggttgcgcatcagccagaacgcggcgagcgcgtgcagcaccagcacgacgacgagcgcaatgcccacgcgcagccagcggcggggcaaggcgtgactcgggcggatgtcggcaggctgcatgggcatcggaacaggatcggggcgctcgcgtgatgtcgggcgcgcggcgcgcacaggaatcggactgtcgaatgcgccgcgcgttcgcgccgcgtgccgtgacgggggcggaatgcgtcaggcgtcgcgcgcgtcgggactatagccgagttcgtaagacagtttctgcgcgcatgcgcgcaacgccgtgtcgatctcgccgccccatgcaatgtcgaacgagccttcctggccgagcgcgacgatggcgagcgcgagttcgccgaccgcatcgaacacgggcatgcagaacgcgtggatcgtcggcagcagcatccctcgacgcgcgcggcctcgtgcttgcgcacgtcggcgagcaccgcctcgacctcgtcgagcgtgcgcgggccgccatggtgcggcgagcggcgcgtatcggcgagttcgcgctcgagcatcgcggcggtcttgctgcgcggcaggtacgcggcgaacagcaggcccgtcgcggagccgagcagcggcatcacgtcgccgagcttcagcgacgccttcgccgggtggctcgattccatccagtgcacgatcgtcggcccctggttgccccacaccgcgatgccgaccgtctggtcgaggcggtcgcggaattcggtcagcgcgatccgcgcgagcttcacgccgtcgacgcgcgcgagccgcgcgagccccatctgcagcgcgaagccgccgagctcgtagcggcccgagacggggtcctgcgacaccacgccgagacgcgagaagctgaccaggtagcggtgcgccttcgcaggactcatgcccgcgcgctgcgcgaggtcgcgcagcatcatcgcgcgcggctcgctcgtcagcacgtcgagcaggcggaagccgacctcgatcgactggatgccggaacggactttctcgctgctttcgccgtgctcgccggaagcggcgtcgtcggtgtcggaatcggcgagatcgtcatcgggaagcgggctggcgggcatgggcggcgggtgcgcgaaaatgcggcaggaatgggggcgaaaaatcggggcgaaaacggcgtgcacgatcgtggcgcgccgccgggattcaccatcgtaaaatagattccctccatcgtcactacaacggcagagtccccttatgaaacttgcttcgctgaaggacggcacgcgcgacggccagctgatcgtcgtgtcgcgcgacctgcacaccgcggcgatcgccgacgcgatcgcgccgacgttgcagcgtgtcctcgacgactgggcgttctacgcgccgcagctgcgcgacctgtacgacgcgctgaaccacggccgcgcgcgcaatgcgttcgcattcgatccggccaactgcatggcgccgctgccgcgcgcgttccagtgggccgacggctccgcgtacgtgaaccacgtcgagctcgtgcgccgcgcgcgcgcgagatgccgcccgaattctggaccgacccgctgatgtaccagggcggcagcgacgatttcctcggcgcgcgcgacgacgtcgtgtgcccgtcggaggagtggggcatcgatttcgaggcggaagtcgcggtgatcaccggcgacgtgcggatgagcgcgtcgcccgacgaagcgctgaaggccgtccggctcgtcacgctggtgaacgacgtgtcgctgcgtaacctgattccggccgagctcgcgaagggctttggcttcttccagagcaagccggccaccgcatttgcgccggtcgccgtgacgcccgacgagctcggtgacgaatggcgcgaaggccgcgtgcaccggccgatgatcgtccactggaacggcaggaaggtcggccagcccgatgcgggcaccgacatggtgtttcacttcggccagctggtcgcgcacgcggcgaagacgcgcaacctgcgcgccgggtcgatcgtcggctcgggcacggtgtcgaacaaggacgcgaagcgcggctactgctgcatcgccgagaagcgctgcctcgagacgatcgagcacggcgcgccgcagaccgaattcatgcgctacggcgataccgtgcgcatcgagatgttcgacgcggccggcaagtcgatcttcggtgcgatcgagcagtcggtcgccccgcccgacggcgcggcgtaagcggcgcggcgcttgcgcgaaacccggcttcggcctgcgcgccgggtttcgcctgatgtttgcccgcgcgggcttggctacactcgattcaagagcctcgactcgaaggagcggcacatggccgatctcgccgcatacggcggttacgaagcactgaaggtgacgcgccgcgaccatggcgtgctcgacatcgtgatgagcggcgaggggcgaaccgcagcggcctcgcgaccgcgaacgcgcgcatgcatcgcgagctcgccgacatctggcgcgacgtcgaccgcgatcccgacacgcgcgtcgcggtgatccgcggcgaaggcaagggcttctcggcgggcggcgatctcgcgctcgtcgaggacatggcgaacgacttcgacgtgcgctcccgcgtgtggcgcgaggcgcgcgacctcgtctacaacgtgatcaactgcagcaagccgatcgtatcggcgatgcatggcccggccgtcggcgcggggctcgtcgccgggctgctcgccgacatctcgatcgccgcgaaggacgcacgcatcatcgacggccacacgcgcctcggcgtcgcggccggcgaccacgcggcgatcgtgtggccgctgctgtgcgggatggcgaaggcgaagtactacctgctgctgtgcgaaccggtgagcggcgaggaggccgagcggatcgggctggtgtcgctcgcggtcgagccggccgacctgctgccgaaggcgtacgaagtggccgagcggctcgcgcacggttcgcagtcggcgatccgctggaccaagtacgcattgaacaactggctgcgcacggccgggccgaccttcgatacgtcgcttgcgctcgaattcatggggtttgccgggcccgacgtgcaggaaggcctccggtcgttgcgcgagcggcgtccacccgagttccccggcgacgccccgttctgacacgcgccggcgctatgatcgatccaggcgcggctcgcgcgacccatggcggccgcctcgtcctcacccagtcaaccaggatgcccgtatgacgaccgatgccccggctccaatcctttcgccggctttgccggcttcaagcccgccgacatgatggaccggatgtgggacatgatgcggatgtcgccgttcggcgcgatgacgccgtttccgggcggcgcgcatgggctgccgccgtcgctgtcgagcatgtccgacatgatggcgccgctcacgagcgtcgaggaactcgacaagcgcatcaccgacctgcgcgcggtcgagcagtggctgaagctcaatctcgggatgctgcagtcggcgatccaggcgctcgaggtgcagcgcgcgacgctcgcgacgctgcgtgcgttcggcgcgttcgcgcagagctcgatgtcggcggccgaggaagcggccgtcgcggcggcgcatgcggcgaaatccgcgtcggctgcgccgggcgatgcgccggcggcggaggatgccgatgcttccgccgcggatgcagccgcgggcgacgccgcgcaggccttcgatcccgccggctggtggaacctgctgcagtcgcagttcaaccagctcgcgagcctcgcgatggcgcagccgggcatgcagcccgccgcgccgggcgatgcgccgccggacgcggccggtgcgccggagcaggccgcgaagccggcaccggctgccgccgccgcgccgcgcaagcctgccgcgaagcgtgccaaatcgaccgacgcgaccggttcggccgcggcgcgcggcggccgcatcgtcgcccgaaacccgtccgccgaagcgttcgacgtgacgcggcgcagatagcaggtcgatcatgcggctcgcgctcgttctgatgggaggcggcgcacgtgccgcctatcaggtcggcgtgctcaaggcgctggccgagatcgcgcgcgaggccgatccgcagcggcatacgctgccgttcgcggtcgtgtgcggctcgtcggccggcgcgatcaacgcaacgtcgatcgcgagccacgcggacgacttttcccatggcgtgcggcgcctgctcgaattctgggagccgttgcgtgctgactacgtgtatcgcaccgactggctcggcatcgcggccgccggtgcgcgctggctcgcgacgatgacgttcggctgggcggcccgccgctcgccgcgcgggctgctcgacaacgcgccgctcgcgcacctgctgcagcgcgagctgagtttccaccggatcgagcagatgctcgaggcgcgcctgctgcacgcgctgtcgatcacggcgctcagctattcgagcggccggcacctcacgttctaccaggcggccgagccgatccaggcgtggcggcgcgcgcagcgcaccgcgcggctcgtcgacctgtcggcgtcgcacctgctcgcgtcgtcggcgattccgttcgtgttcccggccgtgccgctcgtgctcgacgggcagatcgagtacttcggcgacgggtcgatccggcagatcgcgccgctgtcgccggcgatccacttcggcgcgcaccggatcgtcgtggtcggtgcggccgacccgcggcccgagattccggccgcgaacggcacggggctggtacgcggctacccgacgctcgcgcagatcggccagcaggtgctcgcgagcgtgttcctcgactcgatcggctcggacatcgagcgcatcgagcacatcaaccggatgatcgagcacctgccgcaccaggtcgaggtggacagcggctggcggcacgtcgacgtgctcgcgatcgcgccgtccgagcgtatcgagctgatcgccgcgaaacacctgaagcagatgccggcgacgatgcgcgggctgctcggcgcgatcggcggcagccagccggccggcgcgtcgtttgcaagctacctgctgttcgaggaggcgttcacgcgcgaactgatcgagctcggctaccgcgacgggcgcgcgcagcgcgacacgctggccggctggatcgcgctggcggacggcggcagcgcgccggccgccggcatgccgcgggacgacggtctcgcgaccggagaaatacgggtctgatgcgccgggagggtggcggggttgcattttcgcgacggccggccgcgaccgatcgccgcaccgcgattggcggcgcgcgaccgggcaggcgtctcggaaccgtcatgcacgcgtgctatcatggccgccgccgtatacaccatatcgaacagcccgccgatccggcatccgcacggggccctacggggaacccgcctggggcagggacgggctcgtcagcgagccggccagcgccggcccccactcaggcaagcgcgtagccggttccgttcgcacggagcgtggctgcggcatgccgcaacggcggcgcggccgcccggctgccggacgagcaatcggcgtccggccggtcggtttcacgcgtaaaattacagtcttggccgcaaaagcgcgtttggcgcgcctttgcggcaacagtcacgtttagagaagtcgcattgcgcagaacagggtgggaccatcatgaacaccatgctttatccggaactttacaggtcgctcgaagctgtccgctgggacatggagaaggacattccgtgggacaagttcgacgcttcgctgctcaccgacgagcaggcgaagacgatcaagatgaacgcgatcaccgaatggtcggcgctgcccgcgacggagatgttcctgcgcgacaaccagcacgacagcgacttttccgcgttcatgagcgtgtggttcttcgaggagcagaagcattcgctcgtgctgatggaatacctgcgccgcttccggccggagatggtgccgaccgaagaggaactgcacgcggtgcgcttcgaattcgacccggcgccgccgctcgagacgctgatgctgcacttctgcggcgagatccgcctgaaccactggtaccgctgcgcggccgactggcacaccgagccggtcatcaagcagatctacgaaacgatttcgcgcgatgaagcgcgccatggcggcgcctacctgcgctacatgaagaaggcgctgaacaactgcggcgacgtcgcgcgcgcggcgttcgcgaagatcggcgtgctgatggcgtcggcgcgccgcaccgagaagccgctgcacccgaccaacctgcacgtgaaccaggcgctgttcccgcgcgataccgtgcagtcgcgcctgcccgatccggaatggctcgagcgctggctcgacgagcagatccggttcgacggcgagtgggaaaagaaggtcgtcgagcggatcctgcacaacctgtcgatcctgttcgagcgcacgttcgcgaccgcgcaggagctgaaccgctaccgcaaggaagttaccggccgcctgcaggccgaaagcggcccgtcgtcggccgcgcagccggcctgaggccggcaggcgccgccgccggcgtgaatcgcgccggccggtagcgccgtcgtgtcgtatccgttgcatgaagcccgcctggccggcccggcgggctttttatctggcgccgccgtcgcgcgcgccgttgctcatttcgtccgatctccaccatgtccgccaccttcgaacgcaagctgatcacccgtgatgccctcgtcgcgctgcgcgcgtcgctgccgtcacccgtcgtgttcaccaacggcgtattcgacatcctgcaccgcggccacgtcacgtatctcgccgacgcgaaagcgctcggcgcgtgcctgatcgtcggcgtgaacagcgatgcgtcggtgcgcatgctcggcaagggcgacgaccggccgatcaatcgcgaggaagaccgcgcggcactgctcgcggcgctggaaagcgtcgactgggtcgtgacgttcggagaaaagacgccggtgtcgctgatcgaggccgtccgtccggacatcctcgtgaagggggcgattacgacatggacgcgctgccggaatcggcgctcgtgcgcggctggggtggccgtgcgctggcgattccgttcgagcacgaccgctcgaccaccgcgctgctgaagaaggtgcgcgcgcagcagtcctgagtacggcccggcgccgtcagggcgcggacgccgcgagcggggccgtcgtgacggccggcggcgcgatcgggccaccgacgacgggttggtcggtcgcctgcgcgagcggcgtcacgcgcagcgcatcgggccggacctgccgcgacagcacgccgggttcgcgcgggccggccgacggcagcggcccgaacacgccgcgcgccaccacgaacgcgagcatgttggcgagaaagagaacagcgatcagccagcgcagcatcgtcgaacctccttgtcgtcatcgacgtcgttcacgtcattcagtcgagccggccgcatggccggctttttcatggcttccgccggtcgaatgcacgggccgttgcagccgccccgcgcgtaccgcttcgtcagcgtgccgcatgtccttgcggacccgcgtcgccgcacgccggcgcgatgccggcgccggttccgtcaatcctgcgcggcttcggccgcaatcagcgcgagcccggacaggatcagtgcatcgtgtcgcgtatgcggcaccgtcagcgcgcgcgcgacgtcgtccgccgcgccgccggccagcacgagccgcacgggtgcgtgccacgcgtcggcaaggtcgcgccacgcgcgctcgatcagcccggcctgcgcgtacaggcagccggccgacagcgagcgcggcgtatcgacctggaacggatcggcctgcgcacccgcgagcaggccgctcgcgatatcggtggtcagcgtcggcagctgcgcggtgtgcgtgccgagcgcacgcatcatcagcgcccagcccggcgcgatcagcccgccggtgaagcggccgtccgcgcgcagcgcctcgagtgtcgtcgcggtgccgaacgtcgcgatcagcaggtgttcgcccggaaacgccgcgtgcgcgccgatcaggccggcccagcggtcgctgccgagctgttcgggtgtcgtatagccgttcgtcacgccgcattgcgtgtgacgcgagcgtatcgtcgtgcgcggcaggcccggccagcgcgcgtcgagcagcgcgtcgagccgggcggccacgtcggcgcccgcgacgttcgagatccacgcgccgcgcggatgcggcaggttcgaccagtcgggatcggcgccgccgtcgcgcgtgtggccgaatgcgcccgtctcgacgagcgtgcgctgcgcatcggcgagcgcccacttgatccggctgttgccggcgtcgatcagcaggtgcggctcgttcattgcgcttcgcgcagcgacacgtcgccggccgcgatcgcctggatgccgtccggcgtgtcgaggagcagctggccggtcgcgtcgatgcccttcgcgatgccgcgcgcgcgttcgacgccctgttcgagcaggacgacttcgcgccccgcatacgcgtgcaacgcatgccagcgcggcacgaacggcgcgagcccttcggcgccgaaccgcgcgagcgcgggcgtgagcgcattcagcgacgcggcgagcgtatcggtgaggttggccgacgcgcacgcgatcgacagcgcagcgggcggcagcccgctcgcgagcgtcgcttcgcgcgcgcgcagcgcgtcgacctgcgcggcgacggcttccgcgccgcggacgttgatgccgaagccgatcacgacggcggtcgcgtcggcgctggcccaggcggtttcgatcaggatcccggcgagcttgccgacgatgcgaggtgtgccgtcgtcggtggcggtcagcagcaggtcgttcggccatttgagcgcgacgcgcgagcgggcgtcgagcggcagtgtggctagcccttccgcaagcgcgacgccgatcgcgatgctgaggccgccgagcgcgtcgacggggcgcggcacgatgcagccgaccgagcacagcagcgcgttgccgggctgtgcgaaccacgggcggccctgccggccgcggccggccgtctgctcgaacgccacgcgcacgagcggcgcgggcagcgcgttcgcgtggcgcggcagcgccttgagccgggtggcgacgtcggcgttggtcgagccggtggcggcgacgatgtcgagcggccacgcacgcggcgcggcgtccaggtgcgcctcgagccggttgcgcgcgatgtgcgcgtcgccggaatcgggcgtgtcggaggaggtgggggcgttcatggcgcctattgtagcgacaggggcggtggcgcgcgtcgagcggcgcgcgccaccggcagtgatcgaccggcagtgatcgaccggcagtgatcgattggcagtgatcgaccggcagtgatcgattggcagtgatcgaccggcagcaatcgatcggcagtgatcaaccggcagtaatcgaccagcagtgatcgaccggcggcgaccgatcggcaatgaccaaccggcagtgaccaatcggcagcgaccgaccggtagcgacgaaccggcggtgaccgaccagcatccaccaccaaggcggcgcacggccgcccgcatgcgcgcggcgccggcgtgccgccgcacgactcaatgcttttccatctgctccagcgccttgatgtcttcttcggacgtcatttcgcacgcgagcagcgtcttgcccttcagcgccgggccctggcgggccgacacgaggatcagcgcgccgcccgggccgcgcaccgtcaggcggcgcgaatagcctgccgacgacgcgcccagcaggtgccccttttcaggcgcgagcttgtagcgttgcgcgagctggccggcgacttcgccgtccacgagcacgccgatcccggtgctggtgaacacgacgtgctgcgtcgtgaagccgtcccggtggatcggctccggcaggcggaagaccgcggcgcccagcatcgattcgtccggcttcggatcggtggccttgacggtgttgtagatcgagtccatcaggtccgacgtgaacggcggattgcagatcgcggcgttgaagatgtcgggttgggcgggcggcgcggcgaatgcagcgagcggcgcggcggagagggcaatggcaatggcggcggcgccgacggcagcggcgcgacgcccggacaggcgaagggacatgaatgcagttctctcaggttttattgtgaggctgcatgttaatgcatcgccgcacgccggccgatcgacggggagcggccgggtggcggcaatgcaacaggcccgcgcccgcgcgccgcgatcgattccgttgccggatgatcgatgcgcggagcgtcggggcttgcccgtcaggcagccggtgcgatgcgggttcgcgttacggcgcgacgaccggatgcttcagcgcatgcgcggtctcgatccactgcgcgtggaattcgtccgcgtcgggcttgagcccgagctcgccgttgcggtaggccatcgcgagcgtctgcacggcttccggcaactcgtgctcggcggcccggcgatacagcgcgagcgcgcgtgcgtcgtcgcgcggcacgccgctgccgtcgcggtacgcgttcgcgagcatgaagtccgcggccgggatgtccgcgcgcgacgcgacctcgaaccagtgcgcggcctgcacgggatcggcggcgatcccgtagccgctgcgatagatcagcccgaggtaatacgcggcggccgggtcgccctgcgcggccgcttcgccgagcagcgtgcgggcgcgtgcatagtccttcggcatgtcgctgctgccgagcagcaacgccttgccgagcgcgagctgcgcccgccgggcggccggcgcgtcggccttgccgttcgccgtcgcggccgtttccagccagccgcgcccctcgtcgcgcagccccggttcgcgcgcgtcgacgagcgcgatgccgagcgccgcctgcgcgtcgcccgagccgtggcgcgccagcgtgcgcaattgcgcgagcgcgtgcggctcggtggcctgcgtgaccattgcctgccactcgtcgagctgcgcggtgctcggcgtggagccggcgccgcgcaggccggtcgcggcgacgacggccgcgacggtcacggccgccgccgcgagcagtgcggccggcggaagtttcgcgcgcagcacgcgccgcgcggcagcggcgaggccggattcggccggccgcatcgtccggatcggttgcatcgcgtgtctcattgcgtgaggtcgatctcgtaggtggcgaggttcttgcccgagccgtcgtcggccgcgacctgcgtgatgccggtcaggccggccgccgccgcgtcgccgaggcggttcggtgcggacgcgaactgcacgtgcgcgaccgagctcgcgagcttcgtgaagcgccagctgcgctgcgcgccgtccgccgtgcgcgtgatcgcgccgcgcttcttgatgaacgcgatcagcacgtcgcggttcgcatcgggcgacgcgaagatcgtcttgctgccgtcgaggcccgggaagttgccgccgccgctcgcgcggtagttgttggtcgcgacgatgaactgcgcgttcgggtcgatcggcgcgcccttgtacgtcaggttcctgatccggctgccgaccggctgcgtgacgtcgatttcatacgcgagatcggccgacgtgaacatgtcgaagttgtagccggggaaggtgccgacgagcggctgcacggtcgccttggtcgggtcgatccggttgaagcgcttcgcggcggtttcgagccagttcttcacgtcggcgccgctgaccttcaccgcatagacggtgttcggatacaggtacaggtcggccgcgttgttgatcgcgagcgcgcccggtgcgacgtcggtgtagtcggtgccgccgccgaagccgctcttgaacggcgcgctgaccgacagcaccggcagcgacgcgtattgcggcaggttcgcctgcacgtaggtcttcacgtagtcggcctgcgcctcgttgacgatctggatcgcgcccggatcgccgacatcggcgaagtacgagttcatccggtagtcggtcgagccgatcggcgtcttcacgtagtcgatcgtcgcctggtgctcggcggcgatcgcggcggaaaccgacggatcggccgccacgtagctcttgtcggcgttctggatcggccgcgcctcgacggtcgtctgcgacttgtcgacgctccacgtcttgccgtcgaacttcaggccgagcttgatcacgccgaggtgcttgccccagtagttggccatcacggtcggcacgccgttgacggtgcccttgaccttgtcgacgcccggcaggttgaactgcgacacggtgctgttcgcgtccgggaacacctggtgcgagtggccgatcagcatcgcgtcgatgccggtcaccttcgacagccaccagctgccgttctccatcgtcggcgaatacgcggaattgtcgaggccgccgtgcgagatcgcgacgacgagatcggcacccttcgcgcgcatctccggaatgtacttctcggccgcttccttcaggccggtcgtgtagaccttgccgtcgagccagcgcttgtcccagttcatgatcgcgggcggcgtgaagccgatgatgccgatcttcacgggcgcgctgaccgtcttgccgtccggcgtggtcgcggtcacggtgcgggtcaggatcgtgtacggcgtgaacagcggcgcgttggtcttcgcgctgatcacgttcgcgagcacctgcgggaagttcgggcccgcgcacttcttctgctgggccggcgccggcaggccgtcgacctcgaacgtgttgccggtcacctgcgacaggtacggcagcccgtagttgaattcgtggttgccgatcccgccgccgtcgaatttcgcggcgttcatcaccttgtagatcgcgagcgtctggtcgcagccgaccggcttcacgagcgcctggtagtcggacagcgcggtgccctggatcgtgtcgccgttgtcgagcagcagcgtgttcgggtactgcttgcgcgcctgcgcgatcagcgtcgacacgcgttcgaagccgagcgaattgtcggcggcgagcttgaaatagtcgtacgacagcacgttggtgtgcaggtcggtcgtctcgagcagggcgagcgtggccgtcgtgccgacgggcgcctgggctgccggcggcgtcgccggcggcgaggtgacgtcgtcgccgccgcaggcggcgaggatgaaggcgaggctggcgagcgcggcgatggccggcacgcgacggcgggaaagcaggggagacgcatcggttgtcctgttcggtgttctgttttatgaaacgcgaggtgcgcaacgattggcggcgcggggcgccgacggcctgatgtgcggcgcgagagagtatcgaaaggaaacgtgacggaagaatgaaaggtggtgacgtcggcatcgggcaacgggcggcggcttcccgcgcacgccggggcgggcgcccggccgcccggctgcgcgccccgagctcgccgcccgcacggaaatcctcacgtcgcggcgccgggcggttcgctacaatggccgctgtcaccttttgcaaacaacctgcccttggacttcgagactcctcccggcctgtcggtcgacgccggcggccagggccagacggtgcgcctgaccggccagtggaccgcgctctcgcttgcacgcaatcgcggcgcggtggcgcgccgggtcgcgagcatcgcgtccgggcgcgtgagcgaatgggatctgtccggcatcgagcggctcgaccacgtcggcggccaggcgctgtggcgcgtgtggggccgcaagctgccggacggcgtcgcattgagcgccacgcagcgcacgatcttcgagcgcatcgagcggctcgacagcgagcgcgaggcgcccgagcgcgtcgtgcgcgtcgatcccgtcacgcggctcggtcaggcgatcttccggttcggcgagcatctgcagggcggcatcgcgctgttcggcctcgtgatcctcgatgcgctgtcggtgttgcgccgtccgcagacgatgccgtggaaggagacctccgcgaacatctacagcgcgggcgcccaggcgctgccgatcaccgcgctcgtcgcgttcctgatcggcatcgtgctcagctacctgtccgcgcagcagctgcagatgttcggcgcgaaccgctacatcgtgaacatcctcgggctgtcggtgatccgcgagctcggcccggtgctgtcggccattctcgtcgcgggccgctccggctcggcgatcaccgcgcagatcggcgtgatgcgcgtgaccgaggagctcgatgcgatgcgcgtgatgggcatcccgcacgggctgcggctgatcctgccgcgcgtgctcgcgctcggcgtcgcgatgccgctgctcgtgatgtggaccaacatcatcgcgctgacgggcggcgcgctcgcggcgaagctcgtgctcgggatcgacgtcaactatttcgtgcgctcgctgccgggcgtcgtgccgatcgcgaacctgtacatcggggtcggcaagggcgtcgtgttcggcatgctgatcgcgctggtcgcctgccatttcggcttccggatcaaggcgaactcgcagagtctcggcgaaggcacgaccacgtcggtcgtgacgtcgatcacggtcgtgatcctcgccgacgcggtgttcgcgatcctgttccagaacgtggggctcggatgaacgcatcgaacgaaacgaccgcgcacgccgcggccatcggtgccgggtcggtcggcgagcggccggccgcggcggccgctcccggcgatctcgtgatcgaggtgcgcaacctgaccaagcgctacgggcgcaacatcattcaccagaagctcgacttcgacgtgcggcgcggcgagatcgtgtcgatcgtcggcggctcgggctccggcaagaccacgctcgtgcggcagatcctcggcctcgagcggccgacgtcgggcacgatcaaggtgttcggcgaggatacggcgacgatcgacgacgcgagcgcgcggatgatgcgcacgcgctccgggatgctgttccagcagggcgcgctgttctcgtcgatgacggtgttcgacaacgtcgcgcagccgctgcgcgagctcggccgcgtgccgccggacctgctgcacgacatcgtgatgctcaagctcgagatggtcgggctgccgtgcaagcacgcgtcgaagatgccggccgcgctgtcgggcgggatggtcaagcgggtcggcatcgcacgcgcgatcgcgctcgagcccgagctgctgttcctcgacgagccgacggccggcctcgatccgcaggcgtcggacgaattcgtcgagctgatcgcgacgctccaccgcacgctcgggctgaccgtcgtgatggtgacgcacgatctcgacacgatggtcgcgctgtcgacgcgcgtcgcggtgctggccgaccgcaaggtgctggtcgccgcgccggtggaggaggccgcgaacgtcgaccatccgttcatccacgagtatttcctggggctgcgcgggcgccgcgcattgcaggcgctgccgcccgagcggcgcgcgaagctgccgaaggcggccctcgaaccggcgctgtcgagcgtcgagctgtaggaacgaaggaatccgcgaatggaaaacaaatcacatgcgttctgggccggcctgttcacgatcgcgctgacgctcgcgatcgcgggcaccgtgttctggttcaacgtcgaccgcaccgtgcgcgtgccgtacgacctgctcgcgcgcaccaacgtgacggggctgttcccggacgcggccgtgcgctttcgcggcctcgacgtcggcaaggtgcagtcgatcggcttcgaccgcgcgcacccggggcagatccggatccggatcctcgtcgaccacgacgcgccgatcacgcagtcgacctacggcagcctcggcttccagggcgtgacggggatcgcgttcgtgcagctcgaggacacgggacgcgacctggcgccgctgccgtcgtcgccgaaggcgatcgcgcagatcccgatgcggccgagcctgttcgaccagatccaggagcgcggcgacgtgctgctgcggcagctcgaactggccgcgaagagcgcgaatgcgctgatgtcgcccgagatgcgcgagcagttgcgcgcgaccgccgaaagcctgcagcacgcggccgacggtgccgccacgctgacgaagcagctcggcccggcggtcaccgcgctgccggaaacgatgcacgaggtgaaccgcgcgatggcgtcggcgaacacgctgctgcagaacgggccgctcgtgtcgaacctgaacaaggccggcacggccgccgagcaggtcggcgtcgcgctgaacgatctcaacgcgcgcgtgcagtacgacacgctgccgcgcttcaacgcgctggccggcagcgtcggcgatgcgtcgcggcaattgaaggacgtggccggtgaacttggccgcaacccgcgcagtctgttgttcggttcgcccggcgcggcgccggggcccggcgagccgggcttcgtctggccgggtgcgacggccgggcagtgacacccttcgaaaccggaaacatcatgcaggaacacgccatgccacgaatccttgaccgcgcgctgcgtccggccgcggccgcgcttgccgtgctgacgctgacgctcgcggccggctgcgccggcaacagcgcggcgctgtcgaatgtccgctacgacctcgggccggccacgcaggtcgcgaccgcgggcacggcccccgcgctgaaggtgctcgacgtcgtcgtgcccgacgcgctcgactccgacaaattcgcgtaccgtctcgcatatgtggacgcgcagcacgtggccgtctatcgcgacagccgctggacggcaccgcccgcacaactgctcacgcagcggctgcgcggcgcgctgtcgtcgcgcggcacggtgctcgaaggggccgacggcgtgcgcgcgccgaccctcaaggtcgacctgaacgaattcgagcaggtgttcgacggccagtcgcagagctacggcgccgtcaccgcgcgcgcgacgctgacgctggacggcaaggtgctcggccagcgcacgttcgtcgcgcgcgcgccgtcgagcacgcccgacgcggcgggcggcgcccgcgcgctcgcggcggcgagcaacgagctcgtgtcgcagatcgccgcatgggtcggcgtccaggcgtacgcgggcacgccgtgacgcgtgccgcgcagccgcgatgagcgcgatcggcacgcctcgcgcatcgccgctcgcgcggcaggcctttgccgcttacgcggcgctcatcgtctacgcgtcgctgtatccgttcgcaggctgggtgtcgctcggcatcgggccgttcgactacctgttcgcgccgatgcagcgctacgtgaccgcattcgacgtcgtcacgaacgtgctcggctacctgccgttcggcgcgctcggcgtgctcgcgctgcacccgcgctggcgcggcgtggccgcgacgctgatcgtggccgggctcggcgtgctgctgtcgggcgcgatggaggcgctgcaaacctacctgccggcgcgcgttgcgtcgaatctcgatctcgcggccaacgcgctcggcgcgctgctggggcggcgctcgtcgcgccggccaccggtgcgctgctcgatcgcggcgcgctgcgccggctgcgcttcgcgtggttcgaggacgacggtgcgacgccgctgctgctcgccgggctgtggccgttcgcgatcctgttcccgtcgccgttcctgttcggcatcggcgactggccggccgcgctgtgggagcgtgccgacgcgtcgatgcaggacacgctgctcgcgtggctgccggccacgtggcgcgtgggcgaatggcccgagcgcgtcgacggctggctgtccgactccgggtgggaggccgcgctcggcggcctgatgctgttcgccgcgctggcgatcgcgtcgctcgcgatgcggccgcgcgcaccgcgcatccggctgctgatcgcgctcgtcgccgcgacgctcgtgctgaaggcggccgcgaccttcatgcagtcggccaccggccttgtcgtcgtgtgggcgacgcccggcgcgcggctcgggatcgagctcggcttcgcggccgcgcttgtcgcgctgcacgtgccggcgacgtggcgtgcgacgctggcggcgctcgcgctgctggccggcgtggcgctcgtgaacctgctgcccgtcaacccgttcttcgacttcacgctgtcgggctggcggcagggccgctacgtgcacttcaacagcctcgcacgctggctcgcgtggatctggccctacgcggcgctgatctggctcggccagcgcgtcgagcacgcgtggctgccggccgtgctgcgccgctgacgcgaaggctgcggcggttacgccgcgatggccgcggcggtaccgcgggcagcggcgtgcgccctcgttataatcgtccgcacgagtgcagtgttcggcaccaatcggcacttgtgtgcggcgccttcgcacccgtggccgcgttgcaaatcctcgcgatgccatcaggtatcgctgcggtttgcgcgttgccacgagcacgaatccgccggcacacaagcgccgccgggcaccgaacactacacgcccgttgccccgcgcagcggcaaccgctcctctttccgcacggcctcgcgccgggcagctcgccaccaccatggattcctactaccagcaccacgtcttcttctgcctgaaccagcgcgaaccgggcgccgaacgcccgagctgcgcgcaatgcgacgcgcagaccatgcaggaatacgcgaaaaagcgcgtgaaggagctcggcctcgcggggcccggcaaggttcgcatcaacaaggccggctgcctcgaccgctgcgaggaagggccggtgatggtcgtgtatccggaaggcacgtggtacacgtacgtcgaccaggccgacatcgacgagatcgtcgaatcgcacctgcgcgacggcaaggtcgtcgaccgcctgaagatctgagcgggcgggccgaatgaacgttcatacgcagaagtcgctgatcgcgggcccggtcgggcagatcgaaatcgcggtcgacctccccgatgccgtgcgcgaaggcggcgccgcgccgcgcggcatcgcgctcgtcgcgcatccgcatccgctgttcggcggcacgatggacaacaaggtcgcacaaacgctcgcgcgcacgctcgtgcagttgaactacgtggtgttccggtcgaacttccgcggcgtcggcgcgaccgagggcgtgcacgataacggcaccggcgaggccgacgacctgctcgcggtgctcgcgcacatgcgcgcgcagcccgcatacgcggacctgccgctcgtgctcgcgggcttctcgttcggcaccttcgtgctgtcgcacgtcgcgaagcggctgcgcgacgcgggcgagacgatcgaacggatggtgttcgtcggcacggcagcgagccgctggcaggtggccgacgtgcccgagaacacgctcgtgatccacggcgaaaccgacgacacggtgccgatcgcgtcggtgtacgactgggcgcggccgcaggaactgccggtcgtcgtgatccccggcgccgagcatttcctgcatcgcaagctgcacgtgctgaaacgcatcatcgtcgacgcctggcgctagccggcgcgcgggaggccggcgtgacgccggcggcccgcacggtgttgcatgcacgtgctccggccggcgccggacgcgcgtttcccttctcgcgacagcgcgccgcggcgtgcggcgcgacccgacttctccttcgcttgcgcacacctttcgcacaccttcgcgtgcgatgacgcgcggcttgccggcaccccacgcccgatgaagatggacggcgatcctgcgccaggttcgcgaaaacgcgctgcgcggccacgtataatggccggattccgcgtcgcccgcggcccggctgggcccatgcggcgctcgtttcgccgcctgtccgcccgctcgcgacggccgcgaaccgaacgcgtccgcacgagtccaaccggcgcgtttcgcgtcgcccgacgatttcgggcgagtgcccgaaacgcccgccgccttgccgttcaaccctgcgcgtttcgcaccgcactttctgccatcagcctgaatcgatcatgcgtctgtcttcccaaggcctcaagtccctcgcttcctccatcgccttcggcaccgccgcgcgcaacgtcgcgctcggcgtgatgctgcctgtcgcgctcgcgtcgacgatcgtcgtcgccgaggccaagccggccgccaaggccaaggccgcgcatgcggcgccggccgccgagcagttcaccggcgcgcccgcgacctacatgccgggcgcggtgccgccgccgggcgtgaatgcgcgctcgtgggtgctcgtcgatgcgaccagcaacacggtgctcgcatcgggcaatgccgatgaacgcgtcgagcccgcatcgctgacgaagctgatgacggcgtacctcgtgttcgaggcgctcgacaagaagaagatctcgatggagcagatcgtcacgccgagcgaagccgtgcgccgcgtcggccgcgacgagtcgcgcatgttcatcgaggcgaacaagccggtgtcggtgcacgacctcgtgtacgggatgatcatccagtcgggcaacgacgccgcgatcgcgctggccgaactggtcggcggcagcgaagggcagttcgtcacgatgatgaacgacgaggcggcgcgcctcggcatgaagggcacgcacttcgccgacgtgaacggcatgcccgacccgaaccactacacgacggccggcgacctcgcgaagctgtccgcccacctgatccgcgattttccgcagtactacagcatcttctcggagaaggaattcaagtacaacaacatccgccagggcaaccgcaaccgcctgctgtggctggatccgacggtcgacggcctgaagacgggccatacgcaggcagccggctactgcctgatcgcgtcggcgaagcgcgcgatcccgggcgtggacggccagcgccgcctggtgtcggtgatgatgggcgagcagaaggaaagcgagcgcacgcaggacagcatgaagatgctgaactacggctacagcgcgttcgattcggtgcgcctgttcaagggcggccaggcgatgtcgacgccgcgcgtctacaagggcaaggaaaacaccgtgcaggtgggcgtgaagggcgaccagtgggcgaccgtgccgcgcggcctcggcgacaaggtcaagacggaagtcgacgtcaacgcgccgctgatcgcgccgctcgcggcaggccagcaggtcggcaccgtgaagatcgtcgccgacggcaagacgctgtccgaattcccggtcgtcgcactgcaggccgtgccggaagcgggtatcttcgggcgtatctgggactcgatcctgctgatgttcagcaagaagaagtaagcacgacgggcctttgttttcacgacttcatccccatctgtcatagccatgagccaagccgaattcgaaccgatcgtctacctcagcgtgtcgtcgcaggaggaaatggtgccgctgtcggaagcccgtgtaccggtgctcgaccgcgggttcatcttcggcgatggcgtgtatgaagttgtccccgtttatgcgcacgacggcgcgcacgtgccgttccggatcgagcagcatctggcgcggctcgagcgcagcctgaagaagatcggcatcgccagcccgcacgacgacgcgggctggcgcgcgctgatcgagcgcgtcgtcgcggcgaatgccgaagggctcggcgacggcaacgcgctcgtctacctgcaggtgacgcgcggcgtcgcgaagcgcggccacgcgttcccggcgaacgcggtgccgacggtgttcgtgatgacgagcccgctgcgcctgccgtccgccgacgaacgcgcgcagggcgtgcgctgcgtgacggccgaggaccgccgctggctgcattgcgacatcaagtcgatctcgctgctcggcaacgtgctgatggcgcagcatgcggccgaacgcgatgcgttcgagacgctgcagctgcgcgacggcaacctgacggaaggttcgtcgtcgaacgtgtggatcgtaaagaacggcgagctgctcgcgccgccgcgcagcaacaagatcctcgaagggatccgctacgcgctgatcgaggagctggccgacgaatgcaagatcccgttcgtcgcgcgcgagatcagcgaagtggaattgcgcgcggccgacgagatcatgatcacgtcggccacgaaggaagtgctgcccgtcacgtcgctcgacgatctgcccgttcatggcggcaagccgggccccgtattcgcggcgttgtatgacgcgtaccagcgtgcgaaggcacgcgagtttgaacagtttgacctaacccggagaaaatgatgagcgaaccgaccaaaaccatcgaggtgaccggcgcgatcgatacccggaaggagtcgctgctggagtttccgtgcgatttcccgatcaagatcatgggcaaggcgcaccccgagttcaaggacacgatcttcaaggtcgtggccgttcacgacaacgagatcgacgtcgagaagatcgaggagcgtgcgtcgagcggcggcaattacacgggcctcacgatcaccgtgcgggcgaccagccaggaacagctcgacaacatctaccgcgcactgaccggccatccgatggtcaaggtcgtactttaagcgccttccatcctccttcctgcgcgcactcggcggggtcttcccgccgcgcgccgcgcgtccagctcgtcgcacagccgcttgtattcggcgacttcctcgagcagccaggtcctgaacgcctgcacgcgcggcgcgttcagcagcggcggcggacacacgaaaaagtagtgccacgggctcggcccgtcgatgtcgaacaggcgcacgatgcgcccgtcgagcaggtcgtgcaccgcgagcgagcggcgcacgagcgcgatgccctggccgtcgatcgcggccagcagcaggttcgacgaatcctggtacagaatccccgtttcggctcggtcagcgtcttgagtccggccgcgtcgaaccacggccgccacagctcgtcgtccgagcgcagcaggttgtagtgcacgagatcggcgggcgattgcggcagcttgccgccgttcagcgtcggcgcgcatgccggaaagaacacttcgtcgaacagcggctcgacatgcagccccggataactgccgtggccgaagcggatcgcgagatcgacgtcgtcgcgcgcgaaatcggtgagcgagttggtcgactgcagctcgacgtcgatttccggatgccgttcgatgaacgagccgatgcgcggcgtgatgaagcgcgcggcgaacgacgacagcatcgacaccacgagccgccggtcgcggtcgctcgcgcgcacgtcgcgcgtcgcgtcggcgatgaccatcagcgcggtgcggatctgctgcgcgtagcgcatgccggcgtcggtcaggcacagccgcttgccgttgcgcgtgaacagctgcacgccgagctcttcctcgagcgcgcgcacctggtggctgaccgcgccgtgcgtgacgtacagctcgtcggcggcgcgcgagaaattctcgtgacgggcggcggcttcgaacgcgcgaatcgcgttcagcgcaggcagctggcggaggtccatttgctaattttcctcacatcgacgtgaaaattggtcgttttgtcggacgccttgaagtgactacgattgtagccatcgaagcacttattggcggagtcgatcatgcaagaaatttcttcaagcatcacgttcgaaatcccgatgggcgaaaccgtgccgttgaaggtacaacgcagcacgcggctggtggtgcagtgcggcccggtgtgggcgacgcgcagcaacgacgtcgacgattacttcctggtcgacggcgagacgctgaagctgcgccgcggcgagcggctgtggctcagcgcggaaggccgggagggcgcgcgcgtggcgttctcggtgtcgcggccgccccgggaagtcgcgctcggcgggctggcacggctgcgcgaacgcgtgagcgcgctgctccacgacggatggcgcaccgtctgaccatcatttcctccgacggataccggcgatccgccccctccgaggccggcgagaccgacgggttttcggtaaactaccgcccatgtccgtttcgccggtttccatcgtgtccacgcctgttgccgtttccgcatcgcccgccgggtccccggatcagccggccccgccggtcaccgtgcggtggcggggcgtcgagacttacgagacgagcttcgacgcgatgcgtgcgttcaccgacacgcgcacggccgataccggcgacgagatctggctggtcgagcatccgcccgtctacacgctcggccaggccggcgacccggcccacctgctggtggccgacagcggcgtgccgctcgtgaaggtcgaccgcggcgggcagatcacctaccacggccccggccagatcgtcgcctacctgctgctggacctgcgccggcgcaagctgatggtgcgcacgctcgtgacgaagatcgaggaggccgtgatcgaaaccctcgcggcgtataatctcgcttcggtccgcaaggcgggcgcgcccgggatctacgtggcgtccggcgcgcacgagggcgcgaaaatcgcggccctcggcctgaagatccgcaacggctgcagctatcacgggctgagcctgaacgtgaagatggatctgcgcccgtttcttgcgatcaacccgtgcggctatgccggactggaaactgtcgacatggcgagcctcgaggttgccgccgactggaacgacgtcgcccatacgctggtgcgccgtctgatcgccaacctcgacggcgcatccgcggccgccgacaagccgcaggcactggaacaacattcgaatgactgacgttaccgcttccccgcaccggccgatccggccgcgaccctgcctacgatccgaccgccaagcagaaggcgcaggcgaagacggcgcgcatcccgatcaaggtcattccgatcgaaaagctgaagaagcccgagtggatccgcgtgaaggcggccaccggcagctcgcgcttcaacgagatcaagacgatcctgcgcgagcacaacctgcatacggtgtgcgaggaagcgagctgcccgaacatcggcgaatgcttcggcaagggcaccgcgacgttcatgatcatgggcgacaagtgcacgcgccgctgcccgttctgcgacgtcggccacggccgtcccgatccgctcgacgcggatgaaccgaagaacctcgcgcgcacgatcgccgcgctgaagctcaagtacgtggtgatcacgagcgtcgaccgcgacgacctgcgcgacggcggcgccgcccacttcgtcgagtgcatccgcgaaacgcgcgcgcagtcgccggacacgcgcatcgagatcctgacgccggacttccgcggccgtctcgaccgcgcgatctcgatcctgaacgccgcgccgccggacgtgatgaaccacaacctcgaaacggtgccgcgcctgtacaaggaagcgcgcccgggttcggactacgcgcactcgctgaagctcctgaaggacttcaaggcgctgcatccggacgtcgcgacgaagtcgggcctgatggtcggcctcggcgagaccgaagaggaaatcctgcaggtgatgcgcgacctgcgcgcgcacgacgtcgacatgctgacgatcggccagtacctgcagccgtcggagcaccacctgccggtgcgcgcgtacgtgcatcccgatacgttcaagatgtacgaggaagaggcgtacaagatgggcttcacgcacgcggccgtcggcgcgatggtgcggtcgagctatcacgccgatctgcaggcgcatggggcaggggtggtctgagccccttgcttcgtcgacctctgacgaacccgaaaaagcccgcagcgatgcgggctttttcgttggtgcggccgccgcccgcgcattcgcacggcaatcgccacccgaccggacacgcaatccggtcaagcatggaaaggaaagctgaaacagcatcgatagcttcgcaggataagttcgctcccgccgcgcgcaaagctcctatagtcggctctcccgcagcaatgcccgcattcgaaggagagccgcatgtcccgtttcagcttcatccgccgcgccgtcgtcgcgctgaccgcctttgccgcgctgggcgcggcgcacgccgaatcgcgcgaagtcgtgatcgcgtaccaggacatggtcgtgccgtggcgctatgcgcaggcgagcggtgaagtcgaaaaggcgaccggctacaaggtcacgttccgcaagctcgacagcggcgccgacgtgatccgtgcgctcgcatcgggctccgtgcagctcggcgaagccggctcgagcccgatcgcggccgggctgtcgcagggctcgacatctcgctgttctgggtgctcgacaacatcaacgacgccgaggcgctcgtcgcgcgcaacggctcgggcgtcaccaacatcgccgcgctgaagggcaagaagatcggcgtgccgttcgtgtcgacgtcgcatttccatacgctcgtcgcgctgcaggccgcgggcgtcaatccgaacgacgtgaagatcgtcaacctgcgtccgcccgaagtcgcggctgcgtgggcgcgcggcgacatcgacgcgacctacatctgggatccggtgctcgcgaaggtcaagcagtcgggcaccgtgctcacgacgtcgggccaggttgcgaaggaaagcggcaaggcgaccttcgacggcttcgtcgtgagccgcaagttcgcgcgcgagaaccccgagttcgtcacgcgcttcgtgaaggtgctcgcggccgccgatgccgactatcgcgcgcacgctgccgcgtggaaggtcggctcgccgcaggtcgcggcggtcgcgaaggtgtcgggcgcgaacgcgcaggacgtaccggccagcctcgcgctctacgcgttcccgacgccggccgagcaggcgtcgccgacgtggctcggcggcggtgcgcaatcgggcgccgcgaaatcgctcgcggccacggccacgttcctcaaatcgcagggcacgatccagacggtgctcgccgactactcggccggcgtcgatccgcagttcgtgcagaaggcggcgcgctgagcgcggccactcagcccacccgtcgcggagtcctgaacatgagcacgctggaagtccgtcaggtatcggtcgactatccgggcgaacgcggccggccgacgacgcaggcgctcgcgcgcgtcgacctgcgcatcgaggccggtgaattcgtcgtcgcgctcggcgcgtccggctgcggcaagacaacgctgctgaactgcatggccggcttcgtcgcgccgacgacgggcgacgtgcgcgtcgacggcgtgccggtcacgggccccggcgccgatcgcggtgtcgtgttccagaaatacgcgctgctgccgtggctcgacgtgctcgacaacgtcgcgctcgggctgcgcttcgcacgcgtgtcgaaggccgaacgcgaagcgcgggcgcgggagatgctcgcgctcgtcgggctcgacaagcacgcgcatgcgcgcgtgtacgagctgtcgggcgggatgcagcagcgcgtcggcatcgcgcgcgcgctcgcgagcgacccgcgcgtgctgctgatggacgagccgatgggcgcgctcgacgcgatgacgcgcggcacgatgcaggcgctcgtgctcgacgtatgggcacgcaccggcaagacggtgttcttcattacgcacgatgtcgaggaggcgctgtttctcgcgacgcgtctcgtcgtgatgacgcccggccccggccggatcgcggaaaccttcgaactgccgttcgcgcgccgctatgtcgaatcgcgcgatgcgcgcgcggtgaagtcgtcaccggatttcatcgcatggcgcgaacggctgatcgcgtacctgcatcgcgacgaggccgccgaggcggcggcgtgatgcacgaactcgcgcgacagggcgcgtcggtcggacgcggtcggatcagcaccttgcacaggcaggacagcatgagcacgcaggattcttgggcggccgatcgcacggccgcggagcccgggcaggatcaacgcgcgacgcaacggcgtcacgcggcgcgtccggcccgcgcatcgcagcgctaccggctgccggggcaggggaagacggccgggctgagcgcggcgacggtcgcggcactggcactgctgtggtgggtcgccacccatcgccagtggctgccgccgctgttcctgcccgcgccggaagccgtgtggacggcattcgtcgacgcatggcacggccgcatccagggcggcctgccgctgtccgaacatctgttgtggagcgccgcccgcgtgttcggcgcgttcgcgctcgcgaccgcgatcggcgtgccggccggcatcctgatgggcgtgagccgcatcgcgcgcggcgtgctcgatccgctgctggagttctaccggccgctgccgccgctcgcgtacctgccgctcgtcgtgatctggttcggcatcgacgaaacggcgaagctcgtcgtgatcttcctcgcgtgcttcgcgccgatcgcgatggcggcccgcgccggcgtgcgcgcggcgacggtcgagcagatcaacgccgcgtattcgctcggcgggagcttcgcgcagatcgtgcgccacgtggtgctgccggccgcgctgccggagatcctcaccgggctgcggatcgcgatcggcttcggctggacgacgctcgtcgcggccgagatggtcgccgcgacagccgggctcgggcagatggtgctcaacgcatcgagcttcctgcgcaccgatatcgtcgtgatgggcatcctcatcatcggcgcgatcgcttggctgttcgacctcgcgatgcggtgggtcgagcggcggatcgtgccgtggaaaggaaggggctgacgccacgcaggcgcgcggacgacgtccgcgcgccgccacggcccgccaccctcactctcccatcgcaatcccttcccgccgcggatccgccccgccgaaccacaccgtctgcccctgcacgttcagccgctggatcccttgcagccccgaattcatctcgaccacccgcacgtcgtgcccgcggcccttcagcccgtcggcgagcgcatcggacacgcggccgcgttcgagttgcgtcggcccgttcatcgacccgaagttcggcagcgcgatcgcctgctgcatcgtcatccccagtcgagcacgccgactagcgtcttcgcgacgtgattgatgatcgcggggccgccggccgagccgacgatcatcgtcacctgcttcgtcttcttgtcgaacacgagctccggcgacatcgccgagcgcgggcgcttgccgggctgcacgcggttcgcgaccggccggccgttgtcgttcgacacgaacgagaaatcggtgagctggttgttcagcatgaagccgcgcaccatcagccgcgatccgaacgcatcctcgatgctcgtcgtcatcgacagcgcctggccgtagcggtcgacgatcgcgatgtcggacgtcgacggcaactcggggctgcggtcgtcggccatcgcgagtgtcgcgccctgcggcgtgccggcctgcgcgacgcccatgctgctgtcgccgatcaggtgcgcgcgctgcgcgagataggtcttgtcggtgaggctcgcccagctgccgcccggcagcggcacgaaatcgggatcggcgacatagcgcgcgcggtccgcatacgcgagacgcccggcttcgctgaacaggtgcgcggcgaacggcgtcggctcgtagccgacgtcgttgcgcaccggcttctgcgcgccgatctgctgccagtcgggcatcgcttcgaggatgccgagcatctgcgcgatcgcgaggccgcccgacgacggcggcggcattccgcacaccaccgagcgccggtaatccgcgcacagcggcgcgcgcaccttcgccttgtagcgcgcgagatcctggagcgacagcaggcccgggttggtcgggtgcctgcgcaccttcgtgacgatgtcgcgcgcgatcgcgccgctgtagaacgcgttcgcgccgcggtcggcgacttgccgcagcacggtcgcgagcgcggggttcttcagcaccgtgccggccgccttcggcgtgccgtccgggttgtagtacgcgcgcgcggccgggtcgttcttcaggtacttgtcgttggcgatcagcgtcgcgagccgcgggctgatcgtgaagccgcgctcggcgagccggatcgccggctggaacagccggcgccacggcagcttgccgtgcgcacggtgcgcggcgtcgagcatgcgcagcacgcccggcgtgccgaccgagcgcccgccgacgacaccttcgtagaagctcatcggctggccggtcggcccgtagaacaggcggtcggtcgcggcggccggcgcggtctcgcggccgtcgtacgcctgcgtcgccttgccgtcgaagtacagcaggaacgcgccgccgccgattcccgacgattgcggctcgacgagcgcgagcaccatctgcgtggcgatcgccgcgtcgatcgcggtgccgcccgccttcagcatgtcgtagccggcctgcgtcgcgagcggattcgcggccgcgatcatgaagtgctgcgaggtccagcccggcttgtcggtccagccggacgacagctcgggcgcatggacgccgggcagcggcacggcggcgcccgatgcggcggcgacgggcaccaccgcgcccgacggcggcgtggacggggacgtgcagccggcgttgaacgcgacgagcgcgacggcggcgagcagcgtccaggagcgcgaatgcggacgaatccggtcgaacattgaaccctcggcagcagtgaattcgaaggaggcgacgatgccggcgcaacgcggctgcccgccccggcgcgctattgtcgccgcgcggccggcgggttgtcacccgacaggaaaccctgacgcatcgcgccgggcccgccccggccggtctttccggcctgttcgaggatgaactctatgaacgtcgacgtcgcgcgcgtgtggtgccggttcggcatgtagagcatgtacatgtgcgtgccgaagatgctgagccggtacgcgtcgagcgacgtgacgaccgtgccgcgccggatgtcgtcctgcaccacgtagtcgggcacgatgccgacgccgatcccgccgaggatcgcctgccgcaggaacaggaagttctccgaaatcagcgtgggctcgagcagcacctcgtggcgctcgtcgccgagatacgcggcgatcctgagctgccggcccatcaccgtcgcggtgacgacggggaggccgacaacgcgccgaggctcgccggcatcccgtgctcggccgcgaacgcggccgatgcgcacgcgacgtagcgcaccgcgcccatgtcgcgcgcgacgaggttctgcggcggctccggcatcacgcgcaccgcgatgtcgatctcgtcgcgcatcaggtcttccacgcggttctcgaacacgacgtcgagcacgatgcccggatgcagccgcttgaacgcgagcagccagtcggacatcaccatctgcccgtagccgctcggcaccgacagccgcacgcggccctgcaggtcctggccgagcgtcgtcaccgattcctgcgcggcgagcagttcgttgcggatgcgccgcccgtgctcgtacagcttcagcccgatttcggtcggctcgatgcgccgcgtcgtgcgccgcacgagctgctggccgatcgagcgctcgagctggttcagccggtagctgacgttcgcgcggctcatcttgagccgctgcgcggccttgctgagattgccggcgtcgaggatctcgacgagcagcgtcagcgcgttcaggtccatgcgtcgcgtctcctgatccgtcccgtttaacggtccgaaagcattcagtgtcaagtcagacttgacagcttgtaaaagcgggagggaattgtcaatgaatctcgatcaatcgagaatcgggtcatgcccggcgtacggccggatcttgtcccgcttcgtgcgggaccggggcaggcgccccggcgccgctcgcgtggccgcgagctacgaaccggcgtcgacgcgcctgccgccgcgtcaaggagacacgatgaactcacccgcttccccaccggcccggccggcaccgtcacgcgcgagcggcgcgacaaggtgctcgtcgtcacgatcgaccatgcgcccgtcaacgcgctgtccgccgacgtgcggcgcggcctcgccgacgcgctcgacgccgcgcaggccgacgacgcgatccgcgcggtgctgatcgtcggcgccggccgcaacttcatcgcgggcgccgatatccgcgaattcggcaagccgcccgtgccgccgtcgctgcccgacgtgtgcgagcggatcgaatcgggcacgaagccggtcgtggtcgcgctgcatggcgcgacgctcggcggcggcctcgaagtcgcgctcgccgcgcattaccggctcgcggtgcccggcgcgaagctcgggctgcccgaagtcacgctcggcctgctgcccggcgcgggcggtacgcagcgcgcgccgcgcctgatcggcgcgaaggccgcgctcgacctgatgctgacgggccgccacgcgagcgcggacgaagcgctcgcgctcggcctcgtcgaccgcgtcgcacacagcgacgacacgctcgccgaaggcctcgcctacgcgcaggagctcgtgtcgctcggcgcaccggtgcgccgcacgcgcgacgcgcaggggctggccgaccgtgcggccgcgcaggccgcgatcgacgcggcgcgtgccgagttgccgaagaagtcgcgcggccttttctcgcccgcgaagatcgtcgacgcggtcgaggccgcgctcacgcagtcgttcgacgcagggatgaagctcgaacgcagcctgttcctgcagtgcatcgacagcccgcagcgcgcgggcctcgtgcacgccttctttgcggagcgtgaagcggcgaaggtgcccgaggcacgtcgcgcgagcgcgcggccggtcgagcggatcggcgtggtcggcggcggcacgatgggcgcgggcatcgcggtcgcggcgctcgatgccgggctgccggtgacgatgatcgaacgcgacgaagcgtcgctcgcgcgcggcgcgcgtcgacgtcgaaaggtgtacgacggcctcgtcgcgaaagggcggatgacaccggccgcgcacgccgcgcggctcgcgcgtttcaagggcagcacgtcgtacgatgcgctcgcccaggccgacgtcgtgatcgaggccgtgttcgaggacatggccgtgaaaaaggccgtgttcgccgaactcgcgcgcgcgtgcaagccgggtgcggtgctcgcgaccaacacgtcgtatctcgacatcgacgagatcgccgcgagcatcgaccggccggccgacgtgatcggcctgcatttcttctcgccggccaacgtgatgaagctgctcgagatcgtcgtgccggcgcgcgtgagcgccgaagtggtcgcgaccgcgttcgcgctcgcgaagcagttgaagaagacgccggtgcgcgccggcgtgtgcgacggcttcatcggcaaccggatcctcgccgtctatcgcacggcggccgactacctgatggaagacggcgcgtcaccgtaccagatcgaccgcgcggtgcgcgaattcggcttcccgatggggccgttccaggtcgtcgacctcgccggcggcgacatcggctgggcgacccgcaagcgccgcgcggcgacgcgcgacccgcgcgcgcgctacgtggagatttccgaccggctgtgcgagcgcggctggttcgggcagaagacggcgcgcggctactacctgtatccggacggcgcgcgcgtcggcacgccggacccggaagtcgaggcgatcgtcgcgcaagagcgcgcgaagaagggcatcgcaccgcgcacgtttacccacgacgagatcatgcgccgctacctcgcggcgatgatcaacgaaggcgcgaacgtcgtgcacgagaagatcgcgctgcgcccgctcgacgtcgacgcggtgttcctgtacggctacggcttcccgcgttatcgcggcggcccgatgcattacgcggacacggtcggcctcgcgaacgtgctcgccgatatccgcgcgttcgcgaaggaagatccgctgttctggaagccgtcgccgctgctcgtcgatctcgtcgcgcgcggcgcggatttcgcgagcctgaaccgcctcgactgaacgccaaccgcattcgccacggactgacgatggacctcaatttcactcccgaagaggaagccttccgcacggaagtgcagcgcttcctgcaagccgaactgcccgggcgcatcgcgtgcaaggtgaagggcggcctgcatctcacgcgcgacgacatgcgcgaatggcacgcgatactcaacgcgcgcggctggctcgcgagccactggccgcgcgagtacggcggccccggctggagcgtcgcgcagaagttcctgttcgacaacgaatgcgcgctcgcgggtgcgccgcgcatcgtgccgttcggcgtgaacatgctcggccccgtgctgatcaagtacggcgacgaagcgcagaagcgccgctggctgccgcgcattctcgacggcaccgactggtggtgccagggctattcggagccgggcgccggctccgatctcgcgtcggtgaagacgagcgcggtgcgcgggctcgacgcgcagggcgagcactacatcgtgaacggccagaagacgtggaccacgctcggccactacgcgaacatgatcttctgcctcgtgcgcaccgcgaccgacgtgcgcaagcaggaaggcatcagcttcctgctgatcgacatgaacacgccgggcgtcgaggtccgcccgatcatcacgctcgacggcgagcacgaagtgaacgaggtgttcttcaccgacgtgcgcgtgccggcggagaacctcgtcggtgaagagaaccgcggctggacctacgcgaaatacctgctcacgtacgagcgcaccaacatcgcgggaatcggcttctcgacggccgcgctcgaccggctgcgcgcggttgccgcgaaggtcacgaagaacggacgaccgctcgcggacgatccgttcttcgcggcgcgcatcgcgcgcgtcgagatcgaactcgagaacatgcgtacgaccaacctgcgcgtgctggcggcggtcgcgggcggcggggtgccgggcgcggaaagctcgatgctgaagattcgcggcacgcagatccgccaggagatcaccgcgctgatgcggcgtgcgatggggccgtacgcgcagccgttcgtcgaggaggcgctcgatgccgactacgacggcgagccggtcggcccggacgaagcggcgagcgccgcgcagcagtatttcaacaaccggaagctgtcgatcttcggcggctcgaacgagatccagaagaacatcatcgcgaagatgatgctcgggctgtaacgaggagcgcgacgatggatttccagcacacagaagaccgccggatgctggcggacacgttgaaccgcttcatcgccgaacagtatgcgttcccggtgcgcgatcgcatcgcgcagtcggccgagggcttcgatcgcgcgatgtggcagcgctttgccgaactcggcacggtcggcgcattgttcgcggaagccgacggcggtttcggcggcgcgggcttcgacatcgccgtggtgttcgaatgcctcgggcgcgggctcgtcgtcgagccgttcctcggcgcgctgctcgcgggccgcgcgctgtcgctcgccggcggcgacgcgcatcgcgacaggcttgccgcgctgatcgacggcagcgcgagcgccgcgttcgcgcacgacgagccgggctcgcactacgaactgacgaccgtgcgcacgcgcgccgaacgctcgggcgacggctgggtgctcacgggcgcgaagggcgtcgtcgaccaggccgcgcaggcggcgttcttcgtcgtcagcgcgcgcgtgtccgggcaggacgacgacgcggccggcatcggcctgttcgtcgtgccggccgacgcgccgggcgtgtcgctgcgcgactaccggaagatcgacggcggccgcgcggccgaagtgcgcttcgagcgcgtcgcgctgccggccgatgtggcgctcggcgcgcacgacggcgaagcgggcgccgagttgctcgaacgcgtgctcggctacgggctgctcgcgctgtcggcggaagcgctcggcgcgatggacgtcgcgaaggagcacacgctcgagtacctgcgcacacgcaagcagttcggtttgccgatcggcagtttccaggcgctgcagcaccggatggccgacctgctgctcgaagtcgagcaggcgcgctcggccgtgatcaacgcggccgcgcagctcgatgcgccgcacgtggtgcgcgaacgcgcgctggccgcggcgaaattcagcatcgggcggatcggcacgctcgtcgccgaggagagcatccagttgcacggcgggatcgggatgacgtgggagctgccgctgtcgcactacgcgaagcgcctcgtgatgatcgatcaccagctcggcgacgaggatcaccatctcgcgcgctacatcgcgctgtcgaaacagtaaagacgaacgacgcgaatggaggagacaaggatgacgaacgaatcgcgcgttttgccgctggccggcgtgaaagtgctcgacttctcgcgcgtgctcgcggggccgtggtgcgcgatggtgctcgccgatttcggcgcggaagtgatcaaggtcgagcatccggtgcgcggcgacgacacgcgcgactggggcctgaggatcggcgacaccgaaacgacctacttcaacagcgtgaaccgcagcaagcgctcgatctgtctcgacctgcagaccgacgaagggcggcggctcgcgcgcgagctggccgcgcaggccgacgtggtgcttcacaacttcaagttcggcggcgcggagaaactcgggctcggctacgacgcgctggccgaactgaacccgcgcctcgtgcactgcgcgatctccggctacgaccgctcgggcgccgaggccgcgcggcccggctacgacctcgtcgtgcagggcgaggccgggctgatggcgctgaacggcgaagccggccagccgccgctgaagttcggcgtcgcggcggtcgacctgttcaccggcatgtattcggcgcaggcgatcctcgcggcgctgtacgaacgtcatgcgacggggcgcgggcggcgcatcgagatggcgctgttcgactgcgggctgatgatcaccgcgtactacggactcgacgcgctgctgatgggcgaggacccgccgcgctacggcaacgcgcatccgtcgatcgtgccgtacggcgtgttcgacgcggccgacggcccgctcgtgatcacggtcggcaacaacacgcagttcgcgcgcttttgcgacgcgatcgagcggcccgacctcgccgcggacgaacgctacaagaccaacctcggccgctcggagaaccgcgccgacctgctgcccgagattcgtcgcgaactcgcgcgccgttcgcgcgcgactctgctcgcggcgctggccgacgcgggcattccgtgcggcgaagtgctcgggctgcacgaagcgctgacgtcggaacgcgcgacgagcgcggggctcgtgacgcggcagccgcatccggtcgcgggcggcgtcgacgtgctggcgccgccgtaccggttcgacggcgcgcggctgccggtgcgcggcgcgccgccggtgctcggcgccgatacggacgcggtgctcggcggctggctcgggatgtcggccgacgaggtcgcgcggctgcgtgcggatcgcgtcgtgtagttcgatttgccgccacggcgcgggcggggagtcgacgcgcgccgaccattccacacaacaccctcgcaatgacgagttggaaatggagacaccatggagctttccttcatcgaatcggtcacggcgcgccgcgactaccagcagctcgtgcgtgcgcggcgccgtttcagcttcacgctgacggcactgatgatcgccacgtactacggcttcatcctgttcgtcgcgctcgcgccgcacgtgcttgcggcgccgctgtatcgcggcgcgacgacgacggtcgggatcgccgcgggcgtcgcgatcatcctggtcgcgatcgggttgaccgcgtgttacgtgctgcgcgcgaaccgtgcgttcgaccgccgcgtcgacgcgctcctgcagcgttcgtgaaggaggccgacatgcgacgcatctcgatcgcgctccgcgcgcttgccgttcccgcgaccctcgtttcgtctgccgcgcatgcggtatcggtcgcgggcccgatgcccgacaaggtcgaactgaacccggtcgcgatcgggatgttcttcgcgttcgtgttcgcgacgctcgcgctcacgcgctgggccgcgcgccgcacgcgctcgacgcgcgacttctacacggccggcggcggcatcaccgggctgcagaacgggctcgcgatcgcgggcgactacatgtcggccgcgtcgttcctcgggctgtcggggatggtgttcatgttcggcttcgacgggctcatctactcgatcggctttctcgtcggctggccgttcgtgatgttcctgatcgccgaaccgctgcgcaatctcggcaagttcacgttcgtcgacgtcgttgcgtaccgcttcgcacagcggccgatccggctgctgacgtccgcgaattcgctgaccatcgtcgtgctgtacctcgtcgtgcagatggtcggcgcgggcaagctgatccagctgctgttcgggctgtcgtacggcacggccgagctgatcgtcggcgtgctgatggtcgtctacgtgttcttcggcgggatgaccgcgaccacctgggtgcaggtgatcaaggccgtgctgctgctgtgcggcgcgacgctgctcgtcctgctcgcgctcgccgaattcggcttcagcgtcgacgagatgttccgccgcgcggtggccgtgcatccgggcgcgctgtcgatcatgggccccggcaagctgatccgcgatcccgccaacgcgctgtcgctcggcatcgcgctgatgttcggcacggccggcttcccgcacatcctgatgcgcttcttcacggtgccgaacgcgaaggaggcgcgcaagtcggtgctctatgcgaccggcttcatcggctacttctacctgctgaccttcgtgatcggcttctcggcgatcgtgctgctcgcgcagcatccggaattcttcaagctgggcgccgacggttccttcaacctgacgcacgacctgctcggcggctcgaacatggtcgcggtgaagctcgcgcaggcggtcggcgggaactggttctacggcttcatcgcggcggtcacgttcgcgacgatcctcgcggtggtcgcgggcctcacgctcgccggcgcgacgacgatctcgcatgacctgtacgcgcagatgtgggcgcgcggcaagcccgacgagcgcctcgagatgcgcatctcgcgcgcggcgacgatcgcgttgtcggcggtcgcgatcgggctgtcgatcctgttcgagcacgtgaacgtcgcgttcatggtcggcctcgtcgcggcggtggccgcgagcgcgaatttcccggtgctcgcgatgtcgatcttctggcgcgggatgacgacgcgcggcgcggtgctcggcggcggcctcggcctcgtgtcggcggtcacgctcacggtgttgtcgaagtcggtgtgggtcgacgtgctgcatcacgcgcacgcggccgtgttcctcgataaccccgcgctcgtgtcggtgccgctcgcgttcgtcgggatcgtcgtcggctcgctcgcggatcgcggcgagcgtgcgcggcgcgagcgcgctgcgttcgcgcagcaggagttctacgcgcagacgggcttgctggcgggcgaggccgtgcggcactgattcatcggaagaatgcgccaatccgtccgaatccccggacggatattttccggaaatccgccggatttccttgcctgccgcattatgagaaatacaatgaaaacaacggtttgaggggttacggaaacctggcatcgaccttgcgatataaagcgcacggccacccccggccgaactactacagcaagcaaggagacaatcgatgaccactgccttcctcccctccggacgtcctgaggcatcgcttgttgcggcacggcagccgcgcgggcgatttgtttccctgacattcgtccgcgcgcgtgacgccgtttccatcggctcatctacttcagcaggaaccatcgtgaagaagaaacccttctacaaagtgctctatgtgcaggtgatcttcgccatcatcgtcggcgtgatcctcggccatttctacccgtcgatcgccaccgacatgaagccgctcggcgacggcttcatcaagctgatcaagatggtcatcggcccgatcatcttctgtacggtcgtcaccggcatcgccggcatggaggacatgaagaaggtgggccgcgtcggcggcaaggcactcctgtacttcgagatcgtgtcgaccttcgcgctggtgctcggcctcgcggccacgcacatcctgcgtccgggcgtcggcttcaacatcgatccggcgacgctcgacggcaaggccgtcgcgtcgtacgcggcgaaggcgcacgggcagtcgacggtcgacttcctgatgcacatcatcccgaacacgatggtcgatgcgttcgcgcagggcgagatcctgcagatcctgctgatcgcactgctgttcggcagcgtgctcgcgcacctcggcgagcgcggcaaggtcgtcaccgacttcatcgacgggctcacgcgcgtgctgttcggcatcgtgcacatcgtcacgaagctggcgccgatcggcgcgttcggcgcgatggcgttcacgatcggcaagtacggcgtcggctcgctggtgccgctgctcaagctgatcggcacgttctacctgacgtcggtcgtgttcgtgctcgtcgtgctcggcacgatcgcccgcgtcacgggcttctcgatcatccgcttcgtgtcctacatcaaggaagagctgctgatcgtgctcggcacgagctcgtcggaagccgcgctgccgcagctgatggaaaagctcgagaaggccggctgctcgcgttcggtcgtcggcctcgtcgtgccgaccggctattcgttcaacctcgacggcaccaacatctacatgacgatggccgtgctgttcatcgcgcaggcgaccaacatcgaactgacgtggatgcagcagctcacgctgctcgcggtcgcgatgctgacgtcgaagggcgcgagcggcgtcaccggcgcgggcttcatcacgctcgccgcgacgctcgccgtcgtgccgacgatcccgctgtcgggcatggtgctgatcctcggcatcgaccgcttcatgagcgaatgccgtgcgctgaccaacatcgtcggcaacggcgtcgcgaccgtcgtcgtgtcggcatgggagaaggaactcgaccgcaacaagctgcgccaggcgctgaagggcggcggcgaagtcacgccgaccgagacggccggcgtctgacgtcatgaaggagcaggcggcggcatcgcccgcgggcggtgcggcccgcggcggccagggcgggcaggcggaggcctatgacacaataggcgatccgcatcgccaggaagcctcgaccgtgacgcgccgcctgctcattctcgtcgtgcttgccgccgcgctcgccgcggcgtgcacgctgacgtggacgatcacctggcggcgcggcgtcgcagagttgcagcgcaacgccgcggtgcgcgtcgaccgcaccaccaacgcgctcaagagcacgctcgaccgctacgaatcgctgccttatctgctcggcagccatccgtacgtgcaggacctgctcgccgagccgaagcgcaccgactacaccgcacgcgtcaaccgctatctcgaagacctcaacgaacacgcgcacgcgaccgtcacctacgtgatcggcgcggacggcctgtgtgtcgccgccagcaactggcgcgcacccgacagcttcgtcgggatcgaataccgcttccgcccgtatttcctcgatgcgatgaacggccaggtcggccgcttcttcgggatcggcacgatctcgcgcgatcccggctactacatctcgcagcccgtgtggcgcgacggcaggatcgcgggcgtcgtcgtcgtgaagctcaacctcgaatggttccagggcgccgatgcgtccgagccgctcgtcgtcgcggacgaccatggcgtcgtgttcctgtcgtcggtgcccgcctggaagtaccacacgctgcggccgctgacggggcccgtcgccgcatcgatctacgagacgcgccagtacgcgcagcagcccgtcacgccgttgccgctgcgcatcgagcaggtgctgggccccgatgcggagatcgtgcgtctcggcgcgggcctgcgcgcgccgcgctacctcgcgagcaagcgccggatcggcgagcccgactggctgcttgtcacgctggcgccgatcgcgcccgtcgacgccgacgcgcgcaacgcgacgatcgtcacgggcttcggcttcgtgtcggtcgcgctgctcgcgttctactggcggatgcgccgcgcgcgcgtgcgcgaaatgattcgcggccgcgcgctgctgcagcaggcgtacgcggagttgaaccggcgcgtcgaagagcgcacggccgacctgtcggaagcgaacgagcaactgcagaaggaggtcggcgaccggatccgcgcggaacaggaactgcgcgccgcgcacgacgaactgatccaggcgagcaagctcgccgcgcttggccagatggcggccggcatcacgcacgaactgaaccagccgctcgcggcgctgcgcagtttctcggacaacacgcgtgtgctgctcgatcgcggcgagcaggcggccgcgcgcgagaacctcgaggcgatcgccgcgctcacggagcggatgggcaagatcacgaaccagctgaagctgttcgtcggccgcgcgaagccgcgcaacgagcaggcgctggtcgtgcgcgcgctgcgcagcgtgctgtcgttgctcgacgagcgcctgcgcggcgtcgcgctcacgctgacgttgcaggatgcgaccgtgtcgcccgcgcacgatgcgccgctcgacctggcgcgcgactatcccgagctcgtcgcgcgctgcgaggacctgcgcctcgaacaggtgctgatcaacctgctcggcaacgcgctcgacgcggtcgcaggcgtggcggcgccggcgatcgaggtgacgatcggggtgtcggcggcgacgctcgcgatcgaggtgcgcgacaacggctgcggcattgcgcccgacctgctgccgcgcctgttcgagccgttcttcacgaccaaggaaatggggcgcgggctcgggctcgggctcgcgatctcgtcgtcgatcgcgagcgacgcgggcggggcgctgaccgcgcgcaacgcgccgtcgggcggcgcgctgttcgtcttgacgctgcggcgcgcccgcacgcatcatccggactccgtgtccgagccggcgggctcgcgctaggcgcgccatgccgcccgcccgatcggtgcacgatcggtatcaacgccgccgcgcgcgccgccgcgccgtcaggagcaagtgagtacgatggccaaccgcctgcaagtgatctatatcgaagacgatgcgctcgttcgccgggcaagcgtgcagagccttcagctggcggggttcgacgtcgccggcttcgagtcggccgaggcagccgagaaggcgatcgtcgcggataccgccggcgcgatcgtcagcgacatccggctgcccggcgcgagcgggctcgacgtgctcgcgcagtgccgcgagcgcgtgcccgacgtgcccgtgattctcgtcacggggcacggcgacatctcgatggccgtgcaggcgatgcgcgacggcgcgtacgacttcatcgaaaaaccgttcgcggccgagcgcctgatcgagacggtgcgccgtgcgctcgagcggcgcgagctcgtgctcgagaaccacgcgctgcggcgcgagctcgccgggcagaacgtggtcgcgccgcgcatcatcggccgaagccccgcgatcgagcaggtgcgcaagctgatcgcgaacgtcgcgccgaccgacgcgtcggtgctgatcaacggcgacacgggtgccggcaaggagctgatcgcgcgcagcctgcacgagctgtcgccgcgtcgcgacaagccgttcatcgcggtgaactgcggcgcgctgcccgagccgatgttcgaatcggagatgttcggctacgagcccggcgcgttcaccggcgccgcgaagcgccgggtcggcaagctcgagtacgcatccggcggcaccttgttcctcgatgaaatcgaaagcatgccgctcgcgctgcaggtgaagctgctgcgtgtgctgcaggacggcgtgctggagcggctcggctcgaaccagccgatccgcgtgaattgccgcgtcgtcgcggccgcgaagggcgacatgagcgagctcgtcgcggccggcacgttccggcgcgacctgctgtaccggctcaacgtcgtgacgatcgcgctgccgccgcttgccgagcgccgcgaggacatcgtgccgctgttcgagcacttcatgctcgatgcggccgtgcgttacgcgcggccggcgccggtgctgaccgaccggcagcgcgcgagcctgatgcagcgcgattggcccggcaacgtgcgcgagctgcgcaacgcggccgaccgcttcgtgctcggcgtggccgacatgccgcaggagacgggcgcgaacggcggcgacgccgacaacgagcagacgctgaaggagcgcatcgagcaattcgagcgcgcggtgatcgccgaggcgctgaaccagacgggcggcgcggttgccgcgacggccgaccggctgcatgtcggcaaggcgacgctgtacgagaagatgaaacgctacgggctgtcggcgaaaggcgaaaccgagcgctgaaagcgaacggaccgcgaaaccgggttgcccggtcgtgcggtccgtcgtgcggagaaggcgcggcgcgcggcccttcgagtcggatcgggcggcgctcaggccgcgttgctgtcgagtgccttcttgagcagtgcgtcgagctccgcgaactgcggtgcgccgacgtagcgcttcaggatcttgccgtccttgtcgacgacgaaggtcgtcggcgtgagctgcacgttgccgaactgcttcgcgacgctgccgtcgtcgagcgcgaccttgaacggcaactggcgcgtctgcgcatagttcgcgacgtacatcggcggatcgtagttcatcgcgacggcgacgaactccagcccctgacccttgaagcgattataggtatcgaccatctgcggcatttcctgcatgcaggtcgcgcagctcgtcgcccagaagttcacgagatagaccttgcctttcaggtcgcctgcggtcgagaccttctggcccgacagcagcgtgaacgtggcgtccggcacggtggacttgccgttgaacgcgaagaagccggccacggcgatcgccgcgacgacggcggcggcgacgatgtagcggacgggtccggcgctgcgccgggcgggaggcgtggtgttcatctggtgctctcggagtcggtcgatgacgcggatcgaagcaaaggacatcgaaattcggcgctcattttagcgcgaatgcgggatgtgcaccgacggcggccacgcatcccggaattcacgttcggcggataatgcccgttttgcctgcccgctccacgccatgccgaaggaagtcaccgattcgttgcgcccctttttcgtccgctgcgacacttcgccgcgctcgcgtgcatgagcgtcgcgctggccgcgtgctcaccgtcgtatgactggcgcacgctgcacaacgacgccggctacaccgtcgacctgccggcgaagccgaccgtcgagcagcagccggtggcgatcggcggcgcgtcgatgccgatgcggatgcaggccgcgcacgtggacggcgcggtgttcgcggtcggcacgctgacgctgccggacgacagcgacgacacgcgccgcgcggcgctcgagttcctgcgcaccgggctgtcgcgcaacctcgacggcgcgccgcagacggctgcggtgccggtgccgcttgcggccggcggcgcggtgaacgggctcgagctgcgcatcgcgggcgcggccgccggcggcgatcgcgcgcgcaagacgatcgtcgcacggcttgtcgcgcgcggccggcatgcgtaccaggccgtcgtgattgccgacgggccgcttgcccaggagcagctcgaccagtttttcgggtcgttcaagctcgactgacggcctcggcgagggcgccggggcacgtcgtgacaactgaaagttcgttcgcaactttcggcgctagtcgccggattttgcgaggtttttcggctatccacagcgcatgtggataactttgttgaaaagtttcccgaatttcctgccaagccgcgcgggacggccttccggcccatttggtcgctcgcttgcgttttgtgaaaaatcaatcaaaacaatgagatacggattccgtgctgcaaaggtcccgccgagccccgatccggggccggattcgtggaattgtgcataagtcaagtcttgacagccggattttgtcctccgatgacgctcacagcgccgtgagcgcgcgccggtagcggatcgcctcggcgatctgcgcggccgtcggcagcggggcgccggccaggtcggcgatcgtccgtgcgaccttcagcacacggaaatacgcgcgcgccgaccagccgaaacgctcgccggcctcgcgcagcagccgctcgccttcgtcggtcggccggcagagatcgtcggtttctcggccgctcagcatgtgattcgtcttgccctgccggtcgagctgcagcgcacgcgcgtgcgcgacccgtgcggccaccgcggcactcggctcgccgggcgccgtcgcgcgcgacgcgagttcggccggcgacagcgcgggcaggtcgatctggatgtcgatgcgatcgacgagcggccccgacagcttgcgcaggtagcgggcggcgacgtccggcgtgcagcggcagcggccggacggatcgccgtgccagccgcacgggcagggattcatcgcggcgatcagctggcatgcggccgggaagtcggcctgctgcgccgcgcgcgagatcgtgatgcggccggcttccagcggctcgcgcagcatttcgagcacgtgccggtcgaattccgggagttcgtcgagaaacagcacgccgagatgggcgagcgtgatttcgcccggttgcggcgggttgcggccgccgaccagcgcggcggcgctcgacgaatgatgcggggcacggaacggccgccggcgccactgtgccggtgaaaagccgaggcggctcgcggacaggagcgccgccgacgtcagcgcctcgtcgtcggtcagcggcggcaggaggcccggcagccgtgcggccagcatcgacttgccggcgcccggcggcccgatcatcagcatgtgatggccgcccgcggccgcgacttccagcgcgcggcgggcaccgcgctggccgaccacgtcggcgagatcggggcggccggcaccggcaggccgtcgaggcatggcgccgcgaccggtgcgagccgggcgtcgggcgccccggcgaggtgggcgcacagtgcgggcaggtccggtgcaccgaacacggtgacgcccggcacgagcgccgcctcggcggcgctggcgagcggcaggtacagctcgggagcgtttgacgcgacggcggccagatcgggggcggcccgttgatcaccgttgcccgaaccggaagccgctccgctttccgcgacctgccagtcccgcgcgaccccgcacgccatcgcgaacgcgccgcgcatcggccgcagcgcgccggtcagcgacagttcgcccgcgaattcgcggccggccagcgcgtcggccgggatctggccgttcgcggcgaggatgccgagcgcgatcggcaggtcgaaccgacccgactccttcggcaggtcggccggcgcgaggttgacggtgatgcggcgcacggggaattcgaaaccgcagttctgcagcgcggcacgcacgcgctcgcggctttcgcggacctcgagatcgggcaggccgacgatcgagaacgacggcagcccgttggcgagatggacttcgacggtgacgtccggcgcacggccggaggccggcgcgcgactgcgcaccacggcgagcgacatggcgaggctcctgtaaacaagacggacgggcgacggccgttcgtggccgcatgccgcgggaatcggaggaatcggtgcgcgcttgccggcgtggcgcgggaaaagaacgagggactgcgaagaacggggtgctgcgaagaacggggtgctgcgaagaacggggtgctgcgaagaacggggtgctgcgaagagcgaggggcagcgaagagcgaggggcagcgaagagcgagggacagcgaagagcgggggtgctgcggagaacgacttacgacgaagcgcggtagcgcgacttcagggtttcaggttttcggggctggcgggcgcgggccgcacgaggcggcccgcgcccggaccttgaggccgggtggggcgtcaggcttgcggcgcggcgagcttctgctcgagttcggcgacgcgcttttcgagttcctcgaggcgcacgcgggtgcgggcgagcacctgggcctgcgtgtcgaattcctcgcgcgtgacgaggtcgagtttcgaaaagccttgcgacagcatggccttcacgttgcgctcgacgtccttggccggcgagtttttcagcagatcgctgacgcgcgactgcagatcgttgaaaacgtcgctgggttgcttcatgtgattccccttccttgcacaaaaatgtgcatcttcagttgcgtacgtgcccatgatgcacgcatgaccggaaatggtgcgccggggcgcgaattccgggcatggcgccggcatgggtgaatggcccggtgacccgggacgtgcgtgcactctagcaacgttcctttcgccgcgccagcaaagcggcccgcgttggccattcggccgggcttgcgcaccttacatcgcgggatgcaaccccttgatgaagcccttcgaaacggtgctcgaatcgacatggcatgcgagttgctgaggagagtccgttacaacattccaaccaattcgacgggacaactcagcgagaggacttcatgaaactcattaccgcaatcatcaagccgttcaagctcgatgagacgcgcgaggcgctgtcggcgcttggcgtctcgggaatcacggtgaccgaggtaaagggttcggccgccagaaggggcacaccgagctgtatcgcggcgccgaatacgtggtcgatttcctgccgaagatgaagatcgaggcagcggtgtccgacgatctcgtcgaccaggcggtcgaggcgatcgagcgggccgcgcgcaccggcaagatcggcgacggcaagatcttcgtcacggcgatcgaacaggtgatccggattcgcaccggggagacgggcgcagacgcgctgtaacagaacagacaagacaagcgacaagaggaaacccaagatgcgcaaacttctgatgtccctgctgatggccggctcgctgatcgcggcaggcgtcggctccgcgctcgccgacgacgcggcgtccgccgccgctgcgtccgcgcccgccgcaacggcttccgacgcctcggctgccgccgcgccggccgcttcggcaccggctgcaaccgatgcatctgcaccggccgctgccgccgcaccggcttcgggcgccgccgacgcatcggccgccgccgcgtccgcgccggccgcaccggctgcgccgaccgcaccgttctcggtcgattcgtcgaagatcagcgcgggcgacaccgcgtggatgctgacgtcgaccgcgctcgtgctgttcatgacgatcccgggcctcgcgctgttctacgcgggcatggtccgcaagaagaacgtgctcgcgaccgtgatgcagagcttcgcgatcaccgcggtgatcacggtgctgtggacggtggtcggctacagcctcgcgttcacgccgggcaacggcttcatcggcggcctgtcgcgcgcattcctgcacggcatgaactacatcaagggcgacaaggcgacgacgctgaccgtcagccatctcgcgacgacgattccggaatcggtctacttcgtctaccagatgacgttcgcgatcatcacgccggcgctgatctgcggcgcgttcgccgatcgcatgaagttctcggcgatgctcgtgttcatgacgctctggtcgctgatcgtctacgtgccggtcgcgcacatggtgtgggagccgaccggctggctgtcggccgacggcgtgctcgacttcgcgggcggcacggtggtgcacatcaacgccggtatcgcgggcctcgtgtcgtgcctcgtgctcggcaagcgcgtcggctacggccgcgaatcgatggcgccgcacaacctcgtgctgacgatgatcggcggctcgatgctgtgggtcggctggttcggcttcaacgcgggctccgcggtcgccgctgacggccgtgccggcttcgcgatgctgaccacgcaagtggcgaccgcctgcgcggcgctcggctggatgtttgccgagtggatcgcgaagggcaagccgtcggtgctcggcatcgtgtcgggcgcggtcgcgggtctcgtggcgatcacgccggctgccggtttcgtcggcgtggcgggtgcactggtgatcggcatcgccgccggcgtcgtctgcttctggtcggcgacctggctcaagtcgaagctcggctacgacgattcgctcgacgcgttcggcgtgcacggcatcggcgggattctcggcgcgctgctgacgggtgtgttcgcggtcaaggacatcggcggcgccgacggcagcctgctgctgcaggcgaagggcgtgctgatcacgctggtctacagcggcgtgctgagcttcgtgctgctgaagctgatcgacctgacgatgggcctgcgcgtgaccgaagaggaagagcgcgaaggtctcgacgtgatcctgcacggcgagcacgtggaataagtcacacgaatcaacggcgggccgtcgcgacgacggcgcccgccccgaatgagcgcagcgacttcggcccgcctacccggcgggctttttctcctgtcacgcactgacgtagcggataacccttcactctatcgggtcaatagccgaaaacttcctgcatatccttgtgaagccgggaacaatccccaaatgggcaaggcaattgctctacaatcttcattctcccgctcgcgagtgattcatggttccccacctcgttacggcgttgaacggtccgctgctcgaactcgagcagaagatcctcgacgcgacgcctgcgatcgaacgctggttcaggctcgaatggcaggaacacaccccgccgttctattgttcggtggacctgcgcaatgccggcttcaagctggcgcccgtcgacgcgaacctgtttcccggcgcgttcaacaacctgccgtccgaagtgctgccgctcgccgtgcaggccgcgatggccgcgatcgagaagatctgcccggacgcgaagaacctgctcgtgattcccgagctgccgacccgcaacgcgttctacctcgaaaacgtcgcgcgcctcgcgacgatcatgcgccaggccggcctgaacgtgcgcttcggctcgctcgacccgagcatcaccgacatgacgccgatcacgctggccgacggccagaagatcgtgctcgaaccgctcgagcgttcgcagcgccgcctcggcctgaagaatttcgacccgtgctcgatcctgctgaacaacgacctgtcggccggcatcccggccgtgctggaaaacctgcacgagcagtacctgctgccgccgctgcacgcgggctgggccgtgcgccgcaagtcgacgcacttctcgtgctacgacgacgtcgcgaagaagttcgcgaagatggtcggcgtcgatccgtggatggtgaatccgtatttcgcgcacgtggaaggcgtcgactggcaggcgcatgaaggcgagcaggcgctcgccgacgcgatcgacggcgtgctgaagaagatcgcgcgcaagtaccgcgaatacgggatcagcgagaagccgtacgtcgtcgtgaaggccgacgcgggcacggcggggcgcggcgtgatgaccgtgcacgacgcggccgagatcggccggatgtcgaaggccgagcgcgcgcagatggccgagtcgaaggccggcctcgcggtgcgcgacgtgatcgtgcaggaaggcgtgtatacgttcgagcgcgtcggcgacgaagtggccgagcccgttgtcatgatcgaccgctacgtggtcggcggcttctaccgcacgcacgccggccgcgagcgcgaccagaacctgaacgcgcccggcatgcactacgtgccgctcggcttcgagcacaccgcgctgccggatgccggcgcgaagccgggtgccgcgccgccgaaccgtttctacatgtacggcgtcgtcgcgcggctgtcgctgatcgcgtcgtcgatcgaactggaaaagaccgaccccgaagccatccaggtataacggaccttcgccaagtacaggacctcatggacattctctttatcgccgacccgctcgagcgcttcaagatctacaaggattcgacctacgcgatgatggccgaggccgcgcggcgcgggcatgcggtgtacgcgtgccagccgcaccagctcgcatggacggggagcggtgtcgaggcggacgtgcagcgcgtgacgatcgtcggcgacacggccgacctgcaccgcgaaccgtggtacgaggcggccgctcacgagtcgcgtgcgctgacgtcgttcggcgcggtgctgatgcgcaaggatccgccgttcgacatggaatacgtaacggccacgtggatgctcgagcttgccgaacgggcgggcgcgcgcgtattcaacaagccgcagtcgattcgcgatcactcggaaaagctcgcgatcggcgagtttccgcaattcgtcgcgccgacgctcgtcacgcgcgatgcggcgcgcctgcgcgccttccacgccgagcacggcgacgtgatcgtgaagccgctcgacgggatgggcgggatgggcgtgttccgcgtgaaggccgacggcatgaacctcggtgcgatcatcgagatgctcggccatgacggcacgcgctcgctgatgatccagaagttcattcccgagatcaaggccggcgacaaacgcatcctgctgatcgcgggcgagccggtgccgtattcgctcgcgcggattccgcagggcagcgaggtgcgcggcaatctcgcggcgggcgggctcggggtcgcgcagccgctgaccgcgcgcgatcgcgagatcgccgacacgctcgggcccgtgctcgcggcgcgcgggctgttgctggtcggcctcgatgcgatcggcgactggctgaccgaggtgaacgtcacgagcccgacgtgcttccgcgagatcatggagcagacgggcttcgacgtcgccgcgatgttcatcgacgcgctggagcgtgcggccgcgtaggccgtctcccgcgcaaccccggcggcggccgcgcaggtccccgtcgccggagcagctcgaccggcctgctacaatgcccgcttgcccggtgccgcgatcgcgcaccaaaggcccggcggtcgggccgaaactgttgcaaggctgaccatgaaacgtttcccacactcgctacgctcattgccccgccgcgggtatcggcccgccaggggcggccgggagcgatctgacatggccgggatcctgatcatcgcgcacgcccgctcgccaccgcgctgcgggactgcatcgcgcacatctatggcggcgtgcccgcccgcatcggctgtatcgacgtgatggcggacagcgatccggcccaggtgatggcgttcgcgcacgcggagctcgcgcggctccgggaagagaacggcgtggtcgtgctgaccgacatgtacggcgcgacgccggcgaacatcgccggccagcttgcgaagctcgacaacgtgcgcgtgctggcgggcgtgaacctgccgatgctcgtgcgggccgtctgctaccgcaccgtgccgctcgacaagctcgtcgacaaggcgctgtccggcggcgcgaagggcgtccacgaggtgtcggccggcacaccgccgccgccgacggaaaccggctgcggccaatgcgcgccgattccgccggaaccgcaaccgcgcaccgagtcgcactgatttcccgttttcgttttagacagcaccgccggcgcgcgccgccggcggtcccgaccgacccgaccgagaatcatgcttcaacaagaaaccaccatcgtcaataaattggggctccatgcgcgcatcggccaagcttacgcaactggccggtaacttccagtcggaagtctggatgacgcgcaacgggcgcaagatcaacgcgaagagcatcatgggcgtgatgatgctggcggcgggcatcggcagcaccgtgacgatcgagaccgaagggcccgacgagcgggaagcgatggacgcactgctgaaactgatcgcggacaagttcggcgaagggcagtgatccgcgcgcgccgcgcacgggatcgttgccgtttccagtcagaatgccgcggattccgcggcatttttcgtcggaagcattgatgcggaatgcgcaatgctgcggtgcatgcagtcagcggggagtcgcggaatttataatcgctaaccggggtcataagcgcatcgcagcagtgtgccgcggctttacttgtacagaggaggtgcgcgtgtccttcacgctgcatggcattcccgtctcacgaggtatcgcgatcgggcgagcgtacctgatcgcgccggcggcgctcgacgtcgcccattacctgatcgacgcaaaccagatcgatgccgaggtcgagcgcttccgcacggcgctcgatgtcgtgcatcacgaactcgaggcgctgcgcgccgacctgaccgacgacaccccgagcgaggtcggtgcattcatcgacgtccacacgatgatcctgagcgacgagatgctcgtgcaggaaaccatcgacctgatccgcacgcgccgctacaacgtcgagtgggcactgaccgagcagctcgagctgctcacgcgtcacttcgacgacatcgaggacgaatacctgcgcgagcgcaaggccgacatcgagcaggtggtcgagcgcgtgctgaaggcgctcgccggcgcaccgtccgcgtcgcaggcgctcgaccgcgcggccgcgaacggcacgaacgagatgatcgtcgtcgcgcacgacatcgcgccggccgacatgatgcagttcaagtcgcagtcgttccaggcgttcgtcaccgacctcggcggccgcacgtcgcacacggcgatcgtcgcgcgcagcctcggcattccggccgcggtcggcgtgcagcacgcgagcgcgctgatccgccaggacgacctgatcatcgtcgacggcgaccagggcatcgtgatcgtcgatccggcgccgatcgtcctcgaggagtattcgtaccggcagtccgagaagctgctggagcaacgcaagctgcagcgtctgaagttctcgccgacgcaaacgttgtgcggcaccaagatcgatctgtacgcgaacatcgagctgcccgacgacgcgaaggcggccgtcgaggccggcgcggtcggcgtcgggctgttccgttccgagttcctgttcatgcaccagaaggagatgccggaagaggaggagcagttcgccgcctacaagcgggccgtcgagtggatgaagggcatgccggtgacgatccgcacgatcgacgtcggcgcggataagccgctcgaggcgctcgacgaaggctacgagacggcgccgaaccccgcgctcggcctgcgcgcgatccgctggagcctgtccgagccgcagatgttcctcacgcagttgcgtgcgatcctgcgtgcgtccgcgttcggccaggtgaagatcctgatcccgatgctcgcgcacgcgcaggagatcgaccagacgctcgacctgattcgcgaggcgaagcgccagctcgacgacgcggggctcgcgtacgatccgaacgtgcgcatcggcgcgatgatcgagatcccggccgcggcgatcgcgctgccgctgttcctgaagcggttcgatttcctgtcgatcggcacgaacgacctgatccagtacacgctcgcgatcgaccgtgccgacaacgcggtcgcgcacctgtacgacccgctgcacccggccgtgctgcacttgatcgcctatacgttgcgtgaagcgaagcgcgcgggggtatccgtgtcggtgtgcggggagatggcgggcgacccggcgcttacgcgcctgctgctcgggatggggctcaccgagttctcgatgcacccgagccagctgctcgtcgtgaagcaggagatcctgcgcgcacacctgaaggcgctcgaaaagccgacggccgacgtgctcgccgcgttcgagccggaggaagtgcaggcggcgctgcagcgcctgtcggtcgccgagccgcgcgcggatgcggccgcataggcgccacgtcgccgctcaaaaagtagcgaagtgtcaccacgcatgtgccgcctggcgcatgcccgtcgcgcgtcagtgccggcccccgcacacggggcagtcggcctggcgcgcgattttcatcgtcgtccattccatccgcagcgaatcgagcatcatcagccgcccgttgagcgtcttgccgatgtcgccgatcacgcgcagcgcctcggcggcctgcatcgcaccgatgatcccgaccgtcggcgcgaacacgcccatcgtcgcgcacgcgacttcctcgaacggctggtcttccggaaacacgcacgcatagcagggcgcggccgggtcgcggaaatcgaacgtgctgatctggccgtcgaagcgcagcgcggcgcccgacacgagcggcacgccgtgcgcgacgcacgcgcggttgatcgcgtgccgcgtcgcgaagttgtcggtgcagtcgagcacgacggtcgcgctcggcacgtgcgcgtcgagccatgcgtcgtcgacgcgcgcggcgaccgcgtgcaccttcacctcggggttcagttgcgcgagcgtgtcgcgccccgattcgaccttgctgcggccgaccgaggccgtcacgtgcaggatctgccgctgcaggttcgtgagatcgaccgtatcggcgtcgacgagcgtgatcgtgccgacgcccgatgccgcgaggtacattgcggcgggcgagccgaggccgcccgcgccgacgacgatcgcatgcgcatcgagaaagcgctgctgcgcctcgatgccgatttcgtcgacgaggatgtggcgggagtagcgaaggagttgatcgtcgttcatggggagtcgtgggcgaagcggcggacgtgtcgttattttaggcgcgcatgaaaaacgggccatcgcggtcttcccgcgatggcccgtcggatgccggccggcgcttacttcggcgcggacgcgggcttcggtgcggaagccggcttcgcgcttgcgcccgatgccttcggggccgtggcggccttgccggccgtgcccttcgtgctttcggcgagcagcgacttcgattcctgcaccggcttgccttcgagcttgttgagcgcctgctgcatcatgaagtcgtcggcgctgccgaactcgatcggcttgcgatcgcgatccttctggcgctgttccggcgtcttcttgtcgttctgctcttcgaggacgcgcagttgatccatccggcgctgctcgcgctcttcctgttccttcttctcgttcggatcctgcgtgttcgcgaggtggttcgtgtagtcgacctcgcgcgtcacgagcacgtcgtccggatcgccgtccgcgtactgatcgaccggcacgtccggcgtgatgcccttgttctggatcgaacggccgctcggcgtgtagtagtacgcggtggtcaggcgcagtgcggtgtcggccgtcatcgggcggaccgtctgcaccgaacccttgccgaacgtcgtcttgcccatgatctgcgcgcgcttcgaatcctgcagcgcaccggcgacgatttccgacgcggacgccgaataggcgttcgtcagcacgatcatcggcaccgtcttgaagaccggcggcaggttcttcagcggatcgccgtcgaaggacggcaggcgatagttgtcgtacgtatcgcggtagacctgcttcgaatcggggatctggccgttggtcgacacgacgacggagtcgggcggcaggaacgcgccggccacgccgaccgcgctctgcaacaggccgccgccgttgttgcgcaggtcgaggacgaggcccttcaggttcggctgctggcgtgcgatgtcctgcagcttctgcgcgagatcgggcgtcgtgcgctcctggaagctcgtgatgcggacatacgcatagcccggatcgaggatcttcatcttcacgctctggaccttgatgatcgcgcgcgtgacggtgaccgggaacgtgcggtcgtcgctcttgcggaagatcgtcagcgtgaccttggtgcccggctcgccgcgcatctgcttcacggccttgtcgagcgtcatgccgcgcaccggcttgtcgttgatgcgcgtgatcaggtcgcccggacggatgccggcgcggaacgcgggcgtatcttcgatcggcgagatcaccttgacgaggccgtcttcctgcgagatctcgatgccgagacccgcgaagcggcccttcgtctgctcctgcagctcgtcatagtcggtcttgtcgaggaacgacgagtgcgggtcgaggctcgacaccatgcccttgatcgcggccgtcagcagcttcttgtcgtcgaccggttcgacgtactcgcgcttgatctgtccgaagacttccgcgaacaggcggagctggtcgaggggaagcggcgccgtggcggtctgctcggccgatgcggaaacctgcagcgtggcgaacacgcccgtggcgaggcccgcggcaatcaggccgatgttcttcaatttcattcgcatagagatctggtgcggtcgggaagcgcgtggcggtagcggggatgtagcggacaagtataactgttcgtccgaagactcagtggaacggcgcgaattgcgtcgcagcgggcgtcgcggcgggcccggaaggcggcccggccgggcaccgccggcgcgccgcgggttcgaaagcggattcgacagcgccgggggcgcgaaggttcgcgcggtgcgcgggcaagggacggggccgggcatgccgagccggacgcggcccgcccggcctggccggctcacccggccgacgggcgtcagcccgccttgccctgcttcgcgacggcggcctgcgcctgcgcgatcgcgtcctggtcgccgaggtaatagtgcttgatcggcttcaggttctcgtcgagttcatacacgagcggcacgccgttcgggatgttcaggccgacgatgtcgctgtccgagatgccgtcgaggtacttgatcagcgcgcgcagcgagttgccgtgcgcggcgatcagcacttgcttgccggcgcggaccgccggggcgatcgactcgttccacagcggcagcacgcgcgcgaccgtgtccttcaggcactcggtgagcggcagctgctcgcgcggcaccttcgcgtagcgcgggtcgttgaacggcgcgcgttcgtcggtcggctcgagcgcgggcggcggcgtgtcgtagctgcggcgccacacgagcacctggtcgtcgccgaacttcgcggccgtttccgccttgttcaggcccgacagcgcgccgtagtggcgctcgttcaggcgccacgagtggacgaccggcaggtacatcaggtccatcttgtcctgcacgtgccacagcgtgcggatcgcgcgcttgagtaccgacgtgtacgcgatgtcgaacgtgtagccggcctccttgagcaattcgccggcctggtaggcctcgttgcgaccctgttcggtcaggtcgacgtcgacccagccggtgaagcggttttccttgttccacgtcgattcgccgtggcggatgagaacgagtttgtacatggatcttgcggtcggtagtgatagggaagcggggcgcgtcgtacgggacccgaccggggcccgccatcgcgcaagacggttattttataatggcgggattgtcctcatccgatttctcttttccggcggaattccgtgacgttctttaccgattacaccaacctggcccttatcgcgatcctggtggtatccggcggcctgctggcctggcccgcgctgcgccgcggtcgcggcggcctgtcggccgcggaggcgacgcaactcatcaaccgccgcaacgcggtcgtgatcgacgtgcgcgccgcgtccgatttcgcggccggccacctgccgtcggcccgtcaggtcgcggcgggcgagatcggcgcgaagatcgcgcaggtcgcgaagaacaagagcacgccggtgctgctcgtctgccagaacggccagcagtcgcagaaggcggcgcgcgaggtcgaggcggcgggctacgccgaggtgcacgtgctcgagggcggcgtggctgcctggcagcaggccgggatgccggtcgtcaaacaaggagtggcgaagtgaacaaggttttgatgtacagcacgcaggtgtgtccgtattgcatccaggccgagcgcctgctgaagctgcgcggtgtcgagcagatcgagaaggtgctgatcgaccgcgatccggcccgccgcgacgaaatgatgtcgcgcacggggcgccgcacggtgccgcagatctatatcggcgacacgcacgtcggcggctacgacgatctgtcgaagctcgaccgcgaaggcgggctcgttccgcttctgcaagcggcctgattagggcagaatggccgccggccgcgccgcggcttgggcgcgcaggattcatccgtggcggccggcgcgaagccgggccgccccgtcaccacttttaggaaacaccatgtccgacgtcgaaaaccaaccgttcttcaacatccagcgcgtctacctgaaggatatgtcgctcgagcagccgaattcgccggcgatcttcctcgagcaggacatgccgtcggttgaagtcgaagtcgacgtgaaggccgaccgcctcgcggaaagcgtgttcgaagtcgtcgtgtcgggcaccgttaccgcgaaggtgaaggacaaggtcgcgttcctgatcgaagcgaagcaggccggcattttcgacatccgcaacattccggacgaacagctcgacccgctcgtcggcatcgcgtgcccgacgatcctgttcccgtacctgcgttcgaacatcgccgacgcgatcacgcgcgcgggcttcccgccgatccacctggcggaaatcaacttccaggcgctgtacgaacagcgtctcgcgcagcttcagcagcaggccggtgccgcagcaggcgcgccgaacggcacgacgctgaactgacgttttactcggaggaccggtgctgggtatgaaagtagccgttctcggcgccggtgcctggggcaccgcgctcgcgggccatctggccgcgcggcacgatacgcttctgtgggcgcgcgatgccgcgctcatcgccgggctgcaggcccggcacgaaaattcccgctacctggacggcatcgcgctgcctgacgcgttgcgctacgacgccgatctcggcgccgcgctcgcgcacggcgccgcggacgacgctctgtgcgtgatcgccgcgccggtggccgggctgcgcacgctgtgtcacgcgatgcgcgccgcgggctgcgtgcccgcgcacatcgtctgggtctgcaagggcttcgaggccgacacgcatctgctgccgcaccaggtgatcgcggccgagctgcccgaacagcacagcaacggcgtgctgtcggggccgagcttcgcacgcgaggtcgggcagtcgctgcccgtcgcgctgacggtggcgagtacgtccgccgaatgccgcgagcgcacgctcgccgcgttccatcacggcgcgatgcggatctatacgggtgacgacgtggtcggcgtcgaggtcggcggcgcggtgaagaacgtgctcgcgatcgcgaccggtatcgccgacggcctcggcctcgggctgaacgcgcgtgccgcgctgatcacgcgcggcctcgccgaaatgtcgcggctgggcgtcgcgctcggcggccgtgcggaaaccttcacgggcctgaccggcctcggcgacctgatccttaccgcaacgggcgacctgtcgcgcaaccgcacggtcggcctgcaactggcggccggccgcacgctgaacgatatcctcggcgcgctcggccacgtggccgaaggcgtgcgctgtgcgcaggccgtgctggccatcgcgcgggcgcagtcgatcgaaatgccgatcaccgaagccgtgtgcggcgtgctgttcgacggcatcgcgccgcgcgacgccgtcagcggcctgctgcggcgcgacgcgcgcgccgagtagcgcggcccggcgccgcccggtgccgtgttcgccgcgggcgcgcggcgtcaaagcgcgctacgcttgaacagtctccggcgctccgggaggttgtcatgctgcagatccattccaccacgctcgatgcgcagatcgtcgacatcacgacgctcgatgtcgacgcgatcgtcaacgccgcgaacggctcgctgctcggcgggggcggcgtcgacggcgcgatccaccgcgcggccggccccggcctgctcgccgagtgccgcacgctcggcggctgcgacacgggcgacgccaggctcacgcgcggccacgggctgccggcgcgctacgtgatccatgcggtcgggcccgtgtggcatggcggcgggcgcggcgaggccgacctgctcgcgtcgtgctaccgccgcgcgatcgagctggccgaggaggtcgcggcgacgtcgatcgcgttcccggcgatcagctgcggaatctatcgctatccggccgaagaagccgtcgacatcgccgtgggcaccgtcgccgaaatgctgccgcaggcgccgaacctcgcacgcgtggtgttcgcgtgcttttccccgacatctacgacctgtaccgtgcgcggctcgcgcggacgtgacgccttccgcggggcgggaggcgccgtcccggcgtcatgcgccgccttcgaacccggcctggcgccacgcctcgaacacgaccaccgcgaccgtgttcgacaggttcaggctgcggttgtccggccgcatcggcaggcgcacgcgctgttcgttcgggaagcgctcgagcagctcggcgggcaggccgcgcgtctccgagccgaacacgaaccagtcgccgggcaggaatgcatgatcgtggaagcggcccgagccgcgtgtcgtgaacgcgaacattcgcgccggatcgggcgtttccgccgcgatgaacgcgtcccagtcgcggtgtacgcgcatctgcgcatactcgtgatagtcgaggcccgcgcggcgcatccgcgcgtcgtcgagcgggaagccgagcggctcgatcaggtgcaggcgcgcgcccgtgttggcgcacaggcggatcacgttgccggtgttcggcgggatttcgggggcgacgaggacgacgttgaacatgtttcggtttggctgggccggccggggcggcgctacgcgcgtgttcccggccggccggttcgtgacggccgccgccgtgtccggtcggtcggcctctctatctaattaatccctggcggtgcgcagcgcaaccagattcgtcacgcgtgcggcgcccgccgccttcagtgcgtgcgcggcggccgcgagcgtcgcgccggacgtcatcacgtcgtcgacgagcgcaacgtggcggccggcgacgccgcccgccaccgcgaatgccgcgatcacgttgtcgcgccgtgcgtgccggtcgagccgcgactgcggcgcggtgtcggcgacgcgtgcgagcagcgacgcatccgcgcgcaccccgagccgacgcgcgagcgggcgcgcgatcgcccacgcctggttgtagccgcgcgcgacgagccgccggtgcgacagcggcaccggcgccaccaggtcgaagccgcgggcgccgggcgtatcgtcgatcagccgcgcgagccgtgccgcgaattcggcgccgagcgcgagttgccggtgaaacttcaggccgcgcgcgagcccgtcgagcggcgcgcggtaatccgccagcgcgagcgtcgcatcgaacggcggcggtgccgcacggcacgcatcgcaacggtacgcgtccgcactgccggcgcgagcgccgcgggaccggtgcgaacgcggttgcccgatgcccagcggtatcgcgcagacgccgcagcgcagccgcgcttcgttccagtacgcggcgtcgcaggcgacgcaaatcatcgtgtgtgacaaattgccgcacagtgcgcagcgattcggcagcgcgaccgcggcgacgcgcgcggccagcgcgcgaacctgcgacaaagcgacgcgcatcgtgcgccgggcggaactgcggatcatcgcaacactcctgacaccccgcctcaatgaagcccgcggggcgagcgagaggcttcgggctcttcgccagtgtgcccgacatgtccccagcttcgacttcaaccggccgtccggccaatgacgcaaggcgcctgcggcggatcttcgaccgccgcgccgccacgttcgacgcggtcgcgttcctgccgcgcgagatcgcgcagcggatgaacgagcgcctcgaatacatcaaggtaagccccgcggccgtgctggacgcgggctgcggcccggggacgacctgccggcgctgcgcgcgctttccggaggcacccgtattcggcgtcgacctgtccggcgcgatgctcgcgcgagccggtcagcgcgaggtcgagcagacgagctggcgccgctggctgccggcctcgctcggccgtgcgctgggccagcgcggcccccgcgtcgcccaggccgatttcgccgcgctgccgttcccgggcggtgcgttcgacctgatctggtcgaatctcgcgctccactggcattcgcgtccggacacggtgctgcccgaatggcagcgcgtgctgcgcgtgaacgggctgctgatgttcagcacgctcggccccgacacgctgcgcgaactgcgcgcggcctgcgcggatgcggaagcggcgctcggcatcgtgccgcccgccgcgcgcgtgatcgatttcgtcgacatgcacgacctcggcgacatgctcgtcgagagcggcttcgagattcccgtgatggatcaggaagtgctgaccgtcacctacaagaccccgactccctgctggccgacgtgcgccgctggggcgcctatccgttcgagcgcgaggcgccgcagcgcgcgacccggcgctttcgcgcggcgctcggcgacgcgctggaggcgcgccggcgcgcggacggcacgatcgccctgacgttcgaagtgatctacggccacgcgtggaaggccgtgccgcgcacgaccgccgagggcacgggatcgtgcgcatcgaggacatcggaaaggggcgtccgaagaatcggtagagcggtaaagagggttttgttatgtctgaaattagcggcgcaaagcggggtcgaattggcgcctgaaatggccggaaagcttgtcgcgcttggcttgcggggcgatagccgcttgcttgtggatgccattgaacccgcctataatgcgtcagcttgtcgtcccggggtccccgcaatacggggcgacgagtccgatgcaggcatgcatcgcatgccattcgcgtgaggcggcgatggaagcagcgagggttttggcggagacgacgaacggcgagccggtcctcgaagactggctgatgaaacgcaactgttcggcgtcgccgcgccagttcgtgctgttttacgcgtcgctcgcgggcttctcgctggtgatcgcgacattgctgatgtggcgggggcctggctcgtcatgcccttcaccggaatcgagttgctggcggtgggtgtcgcatttgcgatctatgctcgccatgcggtcgattacgaacgcatcaggctgtatccgcaccggctcgtgatcgagcggatggatgcggagcggctcacgcagatcgaattcaacccgcgctgggtgcgggtcgagccgggtgcgacgccacgcgatccgattcggctggtatcgcgcgggcagaccgtcgtaatcgggcagcatctcgcgcagtacaagcgtgcgcagttcgcggacgaactgcgcgcatcgctcaggcgctgcggctgacgaggcgcgggcaccggccggaaacgggccggaggcttgcgacggggagggtttgaatggaaattttgggtaaggatgctatgaaaacaatcaagcgagccctcacgggcgtgctggcatgcagcggattgctctttgccggtgccgccctggcggtcggtgatagcccgggcggcccccgcgtcaacgagatcaactttcagccgccggtcacgaaaatcgccgaggagctctacgatctccacacgatgatgctgatcctgtgtacggtgatcttcgtcggcgtgttcggcgtgatgttctattcgatcttcgcgcaccgcaaatccaagggccacaaggccgccaatttccatgaaagcacgaccgtcgagatcatctggacgatcgtgccgttcgtcatcgtcgtgctgatggcgctgccggcgacgaaggccgtcgtcgcgatgaaggacacgaccaacgccgatctcacgatcaaggtcaccggctaccagtggaagtggggctacgactacgtgaagggcccgggcgagggcatcggcttcctgtcgacgctcagcaccccgcgtgacgaagtgatgggcaagaagccgatcaccgacacctacctgcaggaagtcgacaacccgctcgtcgtgccggtcaacaagaagatccgcatcatcacgaccgcgaacgacgtcgtccactcgtggtacgtgcccgcgttcggcgtgaagcaggatgcgatccccggcttcgtgcgcgacacgtggttcaaggccgacaaggtcggtacgttccgcggtttctgtaccgagctgtgcggcaaggaacacgcgtacatgccggtcgtcgtcgaagtcctgtcggacgaagactacgcgaagtgggtcaccgcgcagaaggccaagctggccggcgccgcagtcgatccgaacaaggtctacacgatggccgaactcgtcgcgcacggcgaggaagtctacaaggcgaactgcgcggcctgccaccaggtgagcggcaagggtctcggcgcattcccggccatggacggcagcccgatcgtgaacggcccgatcgccggccacgtcgagcgcgtgctgcacggcaagggcgcgatgccgtcgtgggcgtcgctgtcggatctcgacatcgcttcggtcatcacgtacgaacgcaactcgtggggcaaccacaagaacgacctgctgcagccgaagcaagtggccgacgcgcgtaacggcaagatgccggaagacaccgcaggcgccgcagcaccggccgaagcggcttcggcgccggcgcaagccgcatcgggcgcagccgaacaaccggcggcagcgtcggcatcggccgcgctgtcgacgatctacttcgagacgggcaagagcgtgctgccggccgacgcgaaagcggcgatcgccgccgcggccgactatgcgaaggcacatccggacgcgaagctcgcgctgtcgggctttaccgacaagacgggctcggccgacgcgaacgccgaactggcgaagcatcgcgcgcaagccgtgcgcgacgcgctgaaggcagcaggcgtggcggaagaccacattattctcaaaaagccggaaacgatcacgggcggggcggacgcgaaggaagcccggcgtgtcgagatcgggccggcggcttgacgtgtcgctgagttagtcgacgtattcgcattaggagattctcatgtctagcatcgggcacgacgtagccgcggaccacgcgcacgacgaccacgcgcacgaaatgccgcacggctggcggcgctggctgttcgccaccaaccacaaggacatcggtacgctgtacctgctgttctcgttcatcatgttcctgtcgggcggcgtgatggccctcggcatccgggccgagctgttcgagccgggcctgcagatcatgcgtccggagttcttcaacgaactcacgacgatgcacggcctgatcatggtgttcggcgcgatcatgccggcgttcgtcggcttcgcgaactggatgattccgctgcagatcggcgcatccgacatggcgttcgcgcggatgaacaacttcagcttctggctgctgccggtcgctgccgtgctgctggtcggttcgttcttcgcgccgggcggcgcgacggccgccggctggacgctctacgcgccgctgtcgacgcagatgggcccgggcatggacttcgcgatcttcgcggtgcacatcatgggtgcgtcgtcgatcatgggcgggatcaacatcgtcgtgacgatcctgaacatgcgcgcaccgggcatgacgctgatgaagatgccgatgttcgcatggacgtggctgatcacggcgtacctgctgatcgcggtgatgccggttctggcgggcgcgatcacgatggtgctgttcgaccgtcacttcggcacgtcgttcttcaacgcggcaggcggcggcgacccggtgatgtaccagcacatcttctggttcttcggccaccccgaggtgtacatcatgattctgccggcgttcgggatcgtgtcgcaggtgatcccggcgttcgcacgcaagacgctgttcggctatagctcgatggtgtacgcgacggcttcgatcgcgatcctgtcgttcatggtctgggcgcaccacatgttcgcaacgggcatgccggtcaccggccagctgttcttcatgtacgcgacgatgctgatcgcggtgccgacgggcgtgaaggtgttcaactggctcgcgacgatgtggcgcggctcgatgaccttcgaaaccccgatgctgttcgcgatcggcttcctgttcgtgttcacgttcggcggtctcacgggcctgatgctcgcgatggcgccgctcgacatccagtatcacggcacctacttcgtggtggcgcacttccactacgtgctggtggccggctcgctgttcgcgctgttctcgggctggtactactgggcgccgaagtggacgggctggatgtacaacgagacgcgcggcaagatccacttctggtcgtcgatgatcttcttcaacctgacgttcttcccgatgcacttcgtcggtctcgccggcatgccgcgtcgttatgcggactacccggcgcagttcacggacttcaaccaggtcgcgacgatcggcgcattcggcttcggcctcgcgcaggtgtacttcctgttcgcggtcgcgctgccggcctaccgtggcggcggcgagctggaaaaggcgtcggacaagccgtgggacggcgcgacgggcctcgagtggacggtgccgagcccggctcccttccatacgttcgagcaaccgccgcacgtcgaataagtttcaccccgcgctccgccgttgcctgccgcgcaggcaggcgcggcgggcgcggaattgaaatgtcagcgaagtttcagatgaaccggaatccacaacaaagacgaacgcccgagcagatccgcgcgggcaacaagcggctcggcctcatcctgctcgtcatcgccgccgtttttttgtgggtgtcgtgatcaagcagtggtggctgtccactcactgatgcagcaacagacgcagtagcgaggaagttgtcgtatgtcgaagccggaagagggcgccgtcgatcgcgcgttcaatcgttcgatgctggtgaagctcttcgtcgtggccgggctgatgttcggtttcggcttcgcgctgatcccgatgtaccgggcgatctgccagatcaccggcatcaacaacctggtgcagcgcgatgtgagcgagcgcgaggtgaagaattcgcaggtcgacaccagccgcacggtgtcggtcgagttcgacgcgaatgcgcgcggcccgctcggtttcaagccggagcacaacagcctcgacgtgcatccgggtgagctgacgacgatcgtgtacgacgtgacgaacgggcagggcaggccggtcgttgcacaggcgattccgagctacgcgccgaagcaggcgacggagttcttcaagaagatcgagtgcttttgctttacgcagcagacgctggccgcgaacgaatcgcgcaagatgccggtggtgttcgtgatcgatccgaaactgccgaaggacgtgaagacgatcacgctgtcgtacacgttcttcgagctgaatacgccggctacgccggcgccgggcaagaccgcggcgcagggcgcggcgaagccggacgcatgacgacggaggcggggcgatgacggaggtcaagcggggcgggtcgttcggtcaggcgctgaaggccgtgctgtggtcgttcttcggggtgcgcaagcggcgcgacctggaggccgacgcgacgcagctgaatccgctgcacgtgctgattgtcgcgttgctggcggccggtgtgttcatcggcgtgctgatcctgatcgtgcgtgccgtcgtgggttgaggcgcgcggccacgaaagaatgcagtgcgcggcgccacggcgccgcgtgcaggaaagagcggtggcggtcacgccgcgcaagaaataaagccggagcggtttccggtacacaaattggacagaagtggagaatcaagcatgagcggtcaaaaccagaccccgtactatttcgtgccgcatccgtcgcaccatccgatcagtgcggccatcggcctgctggtcatgctcggatcggcggcgctgtggatcaacggtcacgactgggcgccgtttacggcactgctcggcctgctgtggttgctcttcacgctgtatcactggttcggcgacgcgatcgccgagtcggaaggcggtcattacggcaagaacgtcgacaagtcataccgctggagcatgagctggttcatcttctcggaagtcatgttcttcggcgcgttcttcggcgcgctgttctatgcacgtgaaatcgcgctgcaccagctcggcagcctcgactacaagctgatctggccggatttctccgccgtgtggccgaacgaaggcccggcagcactcgccggtcacttcaagacgatgggcccgtggccgatcccgacgctgaacaccgcgttcctgctgtcgtcgggcgtgacgctgacgatctcgcaccacgcgctgcgtgacgaccatcgcaagaaggcgatcgcatggctggccgcgacgctcgtgttcggtatctgcttcctgttcctgcagggcttcgagtactaccacgcgtacaacgaactgaacctgacgctgaactcgggcgtgtacggttcgacgttcttcctgctgacgggcttccacggcttccacgtgttcctcggcggcacgatgctcgcggtggtgctggtgcggatgatccgcggccacttcaagcccgatcaccacttcgcattcgaaggcgccgcgtggtactggcacttcgtcgacgtcgtctggctcggcctgtacgtcgtcgtctactggctgtaaatggaaaaacggcccgcgcagcaatgcgcgggccgttttcattggtgtcgtgggcgcggcagcgaggctgcgagcgacaccaccctggcgccgccgcgactcagtcaggcggcgcttttgctggtggcgcggccatgcggcgaaatgtcacagcggcgaccacggcaacggcatcaacgtccgatcggcaggccggtcgaatggatccagcccatccagttcgcgatcaggatgagcaggaacagcgagaccgacagcccgacgcgggtggcgagcgaccagaccatgcgtttcgtgtggccgcggtcgtgcatcatgaagtagagcgccgagcccatgctggcaatgatgaggacgaaggcgatgggaacgagtatgtgcatgacacgaaccggacggcggcaattcggaaggaagaggataattatcgcacttcgcgttccggcacacgccgggcgggctgcatgatgaagattcgctggctgcctgcgctgctgattctcgtcgtcgtcgcggtcacgatccgtctcggtttctggcagcgcgaccgcgcgcaccagaaggaagcgctgcaggcgagcatcgagcgctacgagcaggcggcgcccgtcgacgtcggcgcgcagccgatgccgctcgcgtcgatcgagtttcaccgcgtgcgggcgaagggccgtttcctgcctgaacaggcggtgttcctcgacaatcggccgtataacgaccagccgggtttttacgtcgtgatgccgtttaaactcacgggcggcggcgtcgtgctcgtgaaccgcggctggctgccgcgcaatatcgccgatcgcacggcgatcgagccgttcgcgacgcccgcgggcgacgtcgagatcgtgggcatcgcgcgcgccgacgcgtcgcgtgcgttcgagctcggcgaaggcgggtcggcggcgcaccagaagatccggcagaacctggacgtcgccgcgtatgcgaaggaaacgggctgccgctgcagccgttcgtgatccagcagacgagcgacgacggcgacaagctcgtgcgcgactggccggcggcgacgaccggcgtcgagcgcaattacggttacatgtttcagtggtgggcgatggcggcggccgcgctcggcttcggcctgtatgccgcgcggcgtgcggcgaagaagtcggccggcgcgtgagcgccatgccaggacgcggcgccggcgccgcgggttcgtttcgagaggtctgatttgtccatgcaatcttcccgtcagggttcggccgctgcgccgatgtcgccggcggcccgcaagcgcggccgctggatgctcgtgctgctgggtctcgtgtgcgcggcaccgatgatcgcgtcgtacttcacctattacgtgatcaagccgaagggcggctcgacgaactacggcacgctgatcgagccgcagcggccgatcccccggatctgcaggtgaccgacgaaaccggcaagaccgtgccgctgtcgtcgctgcgcggcgtgtggctgttcgtgatgaccgaccgcagcgcgtgtgacgacgcatgcgcgcagaagctctatttcatgcgccagatccgcgtgacgcaggcgggcgagcggcaccggatcacgatggtgtggctgcgcagcgatgcgggcgcgatgccgcagaaggtgctcgacgcgtaccccgacacgcgccggctcgtcgccgatccggccgcggtggccgcatggctgccggccgatgccggcacgaaggacagcgaccacctctacatggtcgacccgaacggcaacctgatgatgcgtttcccgaaggatccgaaccccagcaagatcaagtcggacgtgacgaagctgctgaagtggtcgagcatcggctaaggcaagacgagaggcaaagaaccgatgtcgtatctactgcaactcggcctgatcggcctgtgcatcgcgctgctgccgctgtcgtacgtgtgggtgaaggccgacgacaacaagtttcgcaagctggtgtggatcaccaccttcctgacgctcgacctcgtgatgttcggcggcttcacgcggctgaccgactcggggctcggctgccctgactggcccggctgctacggcacgtcgtcgccgttcatcgcgcacgccgcgatcacggccgcgcaccaggcgatgccgacgggccccgtcagcatgaccaaggcgtggatcgagatgatccaccgctatttcgcgatggcgatcggcgtgctgatcatcgcgcaggtcgtgatcgcgtggtccgcgaggctgcgccgccgcccgctgcacgtgtcgccgtggtggccgacgagcctgctgctgctgatcctcgtgcagggcgcgttcggcgcgtggacggtcacgatgaagctgcagccggtgatcgtcacgatccacctgctgctcggcctcacgctgctcggcacgctcgggtggcttgcggcgcggcagacgccgctgccgtcgtacgatccggaagccggccgctatcgcgcggccgcgctcgcggcgctcgtgctgctggtcgtgcagatcgcgctcggcggctgggtgagcaccaactacgcggtgctcgcatgcaccgacttcccgacctgcaacggccagtggattccgccgatggacttccagcacggcttccacctgtggcgcgcgctcgggatgacgaaggacggcgacgcgatcacgcaggacgcgctggtcgcgatccactggacgcaccgcacgttcgcgttcgtcgtggtcgcgtatctggtcgcgttcgcgctgaagatgcgccgcttcgaatcgctgcggcgccccgcgaacggcgtgctgctggtcgtcctgctgcagttcgtgacgggcctgaccaacatcgtgctgcagtggccgctgccggtcgccgtcgcgcacaacggcggggccgcgatcctgctgctgctcgtcgtcatgttaaactttcgcatcctttcaagccgccccggccgtgtcgcgcagcctgcgcgcgacgccgccccggcgtgaccgcccccatgcaaagcaccctctcccaatcgcccggtagccgcttttcccagtacatggcgctgacgaagccgcgtgtcacgcagctcgcggtgttctgcgcggtgatcggcatgttcctcgcgacgccgggcatggtgccgtggcacgtgctgatcggcggtacggtcggcatctggctgctggccggcgcggcgttcgcgatcaactgcctcgtcgaacagaagatcgacgcgatgatgcgccgtaccgcgtggcgcccgtccgcgcgcggcgagatcacgacgccgcagatcctgctgttctcggccgtgctcggcagcgtcggcgcatggacgctctatacgttcacgaacccgctgacgatgtggctgacgatcgccaccttcgtcggttatgcggtgatctacacgctgctgctcgccgatgacgccgcagaacatcgtgatcggcggcgcgtcgggcgcgatgccgccggcgctcgggtgggccgcggtcaccggcgcggtgccgggcgacgcgtggatcctcgtgctgatcatcttcgtgtggacgccgccgcatttctgggtgctcgcgctgtatcgccgcaaggattacgagaacgcggggctgccgatgctgcccgtcacgcacggcgagaagttcacgcggctgcacatcctgctgtacacggtgatcctgttcgcggtcacgctgatgccgttcatctccgggatgagcggggccgtctacctgacgagcgcggtgctgctcggcgcggtgttcctcgcgtatgcgtggaagatccatcgcgactattcggacgaactcgcccgcaaggccttccgctactcgatcgtctacctgtcgctgctgtttgccgcgctgctcgtcgatcactatgcacgcccgctgctcggcgtgtaaccgcacggtttgaacgcaatgctccaatcacggttcgggcgccgcgcgcgccaaggctggatgctcgcatgcgcattcacggcagcgctgctgctcgccggatgcgacaacgcgccgaaattccagaatctcgacatcaccggcaacacgcagttcggcagcgacttctcgctgcccgatacggccggcaaggtgcgcacgctcggcgatttcaagggcaaggccgtcgtgatgttcttcggctatacgcactgcccggacgtgtgcccgacgacgatggccgagctgtccgaagcgttgaagcagctcgggcccgatgccgcgaaacgcgtgcaggtgctgttcgtcaccgtcgacccggagcgtgacacgccggcgctgctcggccagtacgtgcccgcgttcgatccgtcgttcatcggcctgcggccggccgacgaagccgcgctgaagaaggtcacgaaggatttccgcgtgtactacgcgaaggtgcccggcaagacgcccggcagctacacgatggatcacaccgccgcgagctacgtgttcgaccgcgacggcaagctgcgcctgttcgtgcgtgacggccaggggcccggcccgtgggtccacgacctgaagctgctggtcgactgaccggcagccgccgggcgcccggcccggcgttgcgcgtgacggccgtcacgcgccgccaccctggttctctcctcgttgttggcatgcgccgcccgtcgggcggcgtgtcggcgtgcgcgcgcatcgcgcacgcgttgcatgtcgcgttacggcagcgcggggacgttgaagccggatgcggcacgcgtgatccggaattccgtcacgcgatacgtggcgagccctcggtgacgaacggatcggttttcaggatcgcgtcgagttcgtcgcgatcgatgcgggccgcgaggatcacgccgccttcgcgcggcaccttcggcccggccgcgatgaagatgcccttgtcgaactgcggctgcaggaatgcgcgatggcgttcgagcgcatcgtcgatgtgttcgagcgatgcggtgtagtggatgtcgatgacgtacatggatggccccggaatggtgccggctcctcgtgtgccggccagccggtcttttagcacagcggatgcgggctgtcgcgccgcgggcggccgaccgaccggcggtttgccgcacccgcgcgtattcaagttgtaagcctcggtgccgtaaataaaaaggcaagcgtttgcgcggggcgggccgttcgcgcgcagcgtgcgcatcgacatcgacaaaggcacgcagatgagcagaatgagtttgaaccgcaagctgtggctcgcgcttgcgctggtatggatcggtctcctgggcgtcggcgcatggagcgcatacgagacacgcgcgacgatgctcgccgaacgcaaggcaggcatcgtgaatctcgtcgactcggcggccggcatcgtgaaggcgtatcacgcacttgcgcagggcggcacgctgcccgaggccgacgcgaagcgcgacgcgctcgcgagcctggccgcgatgcgctatggcgattcgggctacgtgttcgtgatggactcgaagccggtcgtgctgatgcatccgacgttgccgaagctggtcggcacgcaggtcggcgactatctcgacccggacggcaagccgctgttcgtcacgatcctgaacgccgcgaaggaaaccggcagcggcttcgccgagtaccgcgggcgcctgccgcacagcgaaaccgccgcgccgaagatcagctacgtcacgcgtttcacgccgtgggactggaacatctcgagcggcgtcttcctgaaggacatcgacaccatctattaccggacgctgctcggccacctcgcggtcgtgttcgtgatcggcttcgtgatcagcgcggcgatgctggtgatcatccgcaacgtgcgcggcagcctcggcggcgagcccgacgaagcggccgcgctcgcggcgcgcatcgcgcagggcgacctgacgcagccggtgcccgtgcgcgcgggcgaccgtacgagcatgatggccgcgatgcacgacatgcaggcccgcctgcaggcgacgatcggcgggattcgccagtcggccggatcgatcgcgtcggcgagccgccagatctcggccggcaacgacgacctgtcgcagcgcaccgaggagcaggccgcgtcgctggaggaaaccgccgcgagcatggagcagctgaccgcgacggtgaagcagaacgccgacaacgcacgacaggcgagcgggctggcgaacaacgcatcggagatcgcgcgcacggggagcgacgtcgtgaaccgcgtgatcggcacgatgggcgagatcgacgacagctcgcgcaagatcgccgacatcatcggcgtgatcgagggcatcgcgttccagaccaacatcctcgcgctgaacgcggcggtcgaagcggcgcgcgcgggcgagcagggccgcggcttcgcggtggtcgcgggcgaagtgcgctcgctcgcgcagcgcagcgcgacggccgcgaaggagatccgcgagctgatcgtcgactcggtcgagcgcgtgcgcaacggctcgacgctggtcggccaggccggcacgacgatgggcgagatcctgcaggccgtcgcgcgcgtgaccgacatcatgggcgagatcgcggccgcgtccgaggagcaggcgagcggcatcacgcaggtcgggcgcgcggtcacgcagatggatcaggtgacgcagcagaacgcggcgctcgtcgaggaagcggcggcggccgccgcgtcgctgcaggaacaggccgcgcggctgcgcgatgcggtcggcgcgttccgggtcgtcgatgctgacggcttgtcgccgcgccgggccggcgggcagaggggcgagcctgcattcggcacgaaggcggccgaccatgcgacggtggcgtgacgcacaccggctgacgcgcccgtcgctcaaacgcaactaacggccgagtcgcgcagcctccgccggcaccgctgcggtgcatacccatatgagcgggatgtatttcacttcccgccgatcctgtgacaccatttgccccttcctgcgagtcggggcatacccgtatcgcgccccatttccagtaagcaagaaagcgagaaacagatgaagcgtcgcagtctcctgaaggtattttccgtgctggccaccggcgcagcgctgacgctgtcggcaggcgcgcatgccgaagacaaggtgatcaaggtcggcacggtggccggcccggatgcggaagtgtggcagctcgtgcagaaggtcgcgaaggagaaggaaggcctgaacgtgaaggtcatcgagttcaacgactacgtgcagccgaacgcggcgctcgattcgggcgacctcgacgcgaacagcttccagcaccagccttacctcgacagccaggtgaagcagcgcggctacaagatcgtcagcgcgggcctgacctacatctcgccgatcggcgtgtactcgaagaagttcaagacgctgaaggacctgccgcaaggcgcgaagctcgcggtgccgaacgatccgtcgaacgagaaccgcgcgctgctgctgctgcagacgcaaggcgtgatcaagctgaaggcgggcgccggcacgggcggcaacaacgcgacggtgctcgacatcgccgagaacccgaagaagctgaagatctccgaactcgacgccgcgcaactgccgcgcgtgctgtcggacgtcgacgcggccgtgatcaacacgaactacgcgctcgccgcgaacctgcagccgaccaaggacgcgatcgcgctcgaatcgctgacgagcccgtacgcgaacctgattgccgtgcgcgcgaaggacaaggaccagccgtgggtgaagaagctggtcaaggcgtaccagtcgcaggaagtgcgggaattcatcaagaagcagttcaagggctcgatggtcgcgtcgttctgaacgccgcacaccggccggaccgctgaacgaaagggcctgcatcgcgcaggccctttttcaatggcgcggccggtcgggggccgcgggatgccgcgttcggcgccgtctcacatctcgccgcgccgcgagcagatcgacatgatctgctggatcgcatagttgtcgcgcacgcccggcagcgactgcacgacgcactcgtgaaagcgccgctcgcgcggcagcagcatcgcgttgttgcggtacagcgcgtcgcacgagcgctggatcaactgggccgccgcaccgttgcggctctcgcgcagcgcattgagcatgcagtcgtcgtattgcgcgctgccgtcggtcagcgcgaacgccgccccggcaacgccagcgcgacagccgcgaatgcgatggctcggatccccgtttcatgtcgcctccgatggcgtggactgggtcggccgacagcataacgtaaagccgcgagcacggctgacgcgttgcgccggggccggccgaaaccgccgccggccgggcttcgcgcgcggtggcggcgccccggcggcgccgcggcccggcctcttcaagaaagctcggagtcaggcggtggtctgcggaaatggtatcctcgtgcgttcgccgctgcgcgccttcccggggcgcgcacgggccggccgccaccgcgtcgcacgcgtggcggcgcccgcatgacggcggcgggaatccatcatccagaaccgacacaatacggggagacacacccatgaagcgtttcaagactttcgcgatccgttcgatcacggccggcgtggccgcgctcgcgctggccggtgccgcgcacgcacagaccgtcaaggtgctgtcgatcgtcgaccacccggcgctcgatgcgatccgcgacggcgtgcgcgccgaactgaaggcggaaggttacggcgacgacaagctcaagtgggaataccagagcgcgcagggcaacacgggcacggccgcgcagattgcgcgcaagttcgtcggcgaccagcccgacgtgatcgtcgcgatcgcgacgccggccgcgcaggcggtggtcgcgtcgacgaagagcgtgccggtcgtctattcgggcgtgaccgatccggtcgccgcgcagctcgtgaagggctggggcccgtcgggcaccaacgtgacgggcgtgtccgacaagctgccgctcgatcgccaggtcgcgctgatcaagcgcgtcgtgcccaacgcgaagacggtcggcatggtctacaacccgggcgaggcgaattcggtcgtcgtcgtgaaggagctgaaggaaatcctcgcgaagcagggatgacgctgaaggaagcggccgcgccgcgcaccgtcgacatcggcccggccgcgaaaagcctgatcggcaaggtcgacgtgatctacacgaacaccgacaacaacgtcgtgtccgcgtacgaagcgctcgtgaaggtcgcgaacgaagcgaagatcccgctcgtcgccggcgacaccgacagcgtgaagcgcggcggcatcgcggcgctcggcatcaactacggcgacctcggccgccagacgggcaaggtcgtcgcgcgcatcctgaagggcgagaagccgggcgcgatcgcgtcggaaacgagcagcaacctcgagctgttcgcgaacacgggtgcggccgcgaagcagggcgtgacgctcgcgccggatctgctcaaggacgcgaagacggtcatcaagtaagccgcggcccgaccgccgcgcctgcaggcccgatccgggcctgaacgacaccgccggacgggcggctcccacccgggccgcccgttcgcttcgcccggccgtacacgtccggccgggaagcaacaggatttccccaccatgtctctgttctcgtttctgggcgccctggagatcggcctgatcttcagcctcgtcgccctcggggtgctgatctcgtttcgcatcctcaacttccccgacctcaccgtcgacggcagctttccgctcggcggcgccgtcgccgcgacgctgatctccgccggctacgacccgttcagctcgacctgcatcgcgatcgtcgcgggcgcggcggccggcttcatcaccggctggctcaacgtgcgcctgaagatcatggacctgctcgccagcatcctgatgatgatcgcgctctattcggtgaacctgcggatcatgggccggccgaacgtgccgctcatcaccgagccgaccgtcttcaccgtgctgcagcccgactggatgcccgattacgtgctgcgccccgcgctgctcgcgatcgtcgtcgtggtcgcgaagctcggcctcgactggttcttctcgtcgcaactcggcctcgcgatgcgcgcgaccggcgcgaacccgcggatggcgcgcgcgcagggcatcgcgaccggccgcgcgacgctcgccgggatggcgctgtcgaacgcgctcgtcgcgctcgccggtgcgttgttcgcgcagacgcagggcggcgcggacatctcgatggggatcggcacgatcgtgatcgggctggccgcggtgatcatcggcgaaacgctgctgccggcgcgccggctcgtgctgacgacgctcgccgtcgtgctcggcgcgatcgtctaccgcttcttcatcgcgcttgcgctgaacagcgaattcatcgggctgaaggcgcaggacctgaacctcgtgacggccgcgctcgtcacgatcgcgctggtgctgccggcaacgcgcaagaagctgttcgcgcgcaagaacggaggggcctgacatgctgtccgcacaagacctgaaactgacgttcaatcccggcacgccgatcgagacgcgcgcgctgcgcgggctgtcgctcgagattcccgacggccagttcgtcgcggtgatcggctcgaacggcgccggcaaatcgaccttcctcaatgcgatcagcggcgaccaggccgtcgatgcgggacgcatctcgatcgacggcacggacgtcacgcgcaaggccgcgtgggatcgcgcgcacctcgtcgcgcgtgtgttccaggatccgatggccggcacttgcgaggcgctgacgatcgaggagaacatggcgctcgcgatggcgcgcggcgcgcggcgcggctttcgcgcggcgctcgaccggccgtcgcgcgagctgttccgcgacaagctgcggctgctgaacctcgggctggaaaaccggttgaccgaccggatcggtctgctgtcgggcggccagcggcaggcggtgagcctgttgatggcgtcgctgcggccgtcgcggatcctgctgctcgacgagcacacggccgcgctcgacccgaagacggccgcgttcgtgctggagctgaccgcgcgcatcgtcgccgagagcaggctgacgacgatgatggtcacgcacagcatgcggcaggcgctcgactacggcgaccgcacggtgatgctgcaccaggggcaggtcgtgctcgacgtgtcgggcgacgcgcgcaagggctcgacgtgccggacctgctgcagatgttcgagaaggtgcgtcacgagcagctcgacgacgacgcgctgctgctcggctgacgggcggctggcgggccggcgcggcgcggggtgttgcatcgtgccggttcgcgtgagggttggcgtgccggcccggcgagtcgggtcgggtcgacaaagtcggctcgacgaatcagcccgacgaattggggtggcgcggcgggtcggcaattcggcccggttggcggtggcgcgcgttcgggcggcacgatccggccatgcccgctccggtgcggcgtaacatgacggccgcgccggctttcccgtcgttttcctctgacgaaaaccggtttcgcgccggtgctgtgcgacgcgagcgcattgccatatactgtatatccatacagttgtgggtggcgtcatgctcgcatcctccatttctcccgaatcccttcatccgtcgctgtggcgcggttcccagctcgcgcgcggtggcccgcgcacgatcgataccggcttcgccccgctgtcggccgagctgccgggcggcggctggccggtcggcgggctcgtcgaactgctggccgcgcagccgggctgcggcgagatgcggctgctcgcgcccgcgctcgcacgcaccgtcagcgcgcgccgtccgcttgcgctcgtcgcgccgcctcaatcgccgcatgcaaccgcgctcgccagcctcggcgtaccgtccgacgcgctgctgtggctgcgtgccggcagccgcaccgatgcgctgtgggccgccgagcaggcgctcaagacgggtgctgcggcgcgctgctgctctggcaggatgcgcggcccgatgcgctgcggcgcctgcatctcgcggccgcgcgcacgggcgacacgctgttcgtgatgctgcgtccgctgtcggccgcgcggcaaccgtcgccggccgtgctgcgtgtcgcgctgtatccggtgccgggcggcgtgtcgctcgacatcgtcaagcgtcgcggccccgcacgcggcgagccgctcgtgctcgacctgccgtcgcccatcgtggagagccgctatgcgcgtcttgctcggcatccatctgccgcgcctgccgctcgacgtgtgcgccccgccgccgtctgacggcgcggcgcaacgcgtagacgaagcggacgaagcggacgaagctggctgtgcggtgctcgagcagggtgtcgtgctgatcgccgatgcgcccgcgcgccggcagggcgtgcgcgcgggcatgaagcgcggcggcgtgctcacgctcgcgccgcacacgcggctcgtcgaacgcgaccccgcgcgcgaggccgatgcgctgcgtgcggtcgcgctcgcgttgctgcgcttttcgccgtgcgtcgcgctcgacgacgaagccacgctgatcgtcgatgtcggcccgagcctgcgcctgttcggcggcctgccgtcgctgtgccgacaggtgcgcgcgacgctcgcggcgctcggctatgcggcgcgcctgtccgccgcgccgaccgggcggggcgcgtggctgctcgcgcgcgtgtcggcccgtgcacgcatccggcgccgcgtcgccggccaggtgtcgctcgtgcgttcgctcgacaggctgccgtgcgtgctgctgcccgatgcgcgtccgtatgcgggctggttcgacggcctcggctgccgcacgctcgccgacctgcgcaacctgccgcgcgcgggctgcagcgccgctgcggtcccgcgttgctggccgcgctcgatcgcgcgtacggcgatgcggtcgagccgctcgcgtggatggcggtgccgcccgtgttcgacgtgcggctcgaattgccggagcgtgtcgaatacgcggaagccgtgctgttcgccgcgcggcggctcgtcgtgcagctgtgcggctggctggccgcgcggcagctgtcgctggccgcgatgacgttcgatctcgagcacgagcgcggccgtcaggccgtgccgccgacgccgctcgaactcgcgttcgccgcacccgtgcgcgacgagacgcacttcatgcggctgctcggcgagcggctcgcgcgcgtcgagttgccggccgcggtgatcgcggtgcgtctgaaggccacgcgcgtcgaatcggtcgcgccgccggccgacgatctttttcccgagccgggcggcacgaaagagacgcgcgcgcggttgttcgagctgctggtcgcacggctcggcgcggagaacgtgctgcgcgcggcacccgtcgccgatcaccggcccgaggccgcgaaccgctggctgccgctcgatgcgcaggccggcaagccggcgggcgggccgccggccgtgccgccgaggcccgcgtggttgctggacgagccgctgccgctgctgatgcgggggagcggccggtatttcatacgccgctcaggatgatgtcgtcggtggagcggatcgaggccgggtggttcgatggccagctcgccgcacgcgattaccacgtcgcgcaggacgaaaccggtgcgtgctactgggtgttcaaggagcgggcagcgagcgaggccgagccgcgctggttcctgcacggcctgttcgggtgaacggtcatggttgcggaattcagctggctgcccgattacgcggagttgttctgccgttcgaacttttcgttcctgcatggcgcgtcgcatgcggaagaactggtcgagcgtgcggcggaactcggctatcgcgggatcgcgatcaccgacgaatgctcgctcgccggcgcaccgcgcatgcacgtcgcggcgaaggcgaaagggttgccgctcgtcatcgggtcgtacttcgaagtcacaccggatgaagtcgcaccgggccacgatccgggccccggcgcgttcgggctcgtgctgctcgcgcagaatcgggaaggctacggcaacctgtccgagctgatttcgtggcggcggatggaagcgccgaaggggacttacacgctgacgtcgcacatgctgtcgaggccgcccgaggcattcgcacacctgcgcggcatgcccgactgcttcgcgattctcgtgcccgcgtatccggtgcgggcggacgtgctcgatgcgcaggtcgcgtggtttcgcgcgacgttcggcgagcgtgcgcggctcgggctcgtgcagttgcagcgcgcgctggacggtgcgcagcgcgaggagattcgtgcggccggcgagcggcgcggcgtgcgcatcgtcgcactcggcgacgtgacgatgcaccggcgctcgtgcaaggagctgcaggacgtgatgacggcgattcgtgtcgggatgcctgtcgcggaatgcggttatgcgctcgcgccgaatgcggagcagcatctgcgtgcgcgcgggcggatcgggaagctgttttcgccggaagagatcgcggaaacgtgcgcgatgctcgacggctgcaatttctccctcgatgacctgaagtatgaatacccgctcgaactcgtcccgcgcgggcatacgccgacgagctacctgaagcaggagacctgggcgggtgtggcccggcgttactggaatggtgtgccggagaaagtagccaggcagatccggtatgaactcgccctgatcgcgaaactgaaatacgagccgttcttcctgaccgtctacgacatcgtcaaattcgcgcgcagccagaacatcctgtgccaggggcgcggctcggcggcgaactcggtggtctgctattgcctcggcattaccgaggtcgatcccgatcagagcacgatgctgttcgagcgcttcatcagcgcggagcgcggcgagccgcccgatatcgacgtcgatttcgagcatcagcgccgggaagaagtgatccagcatatctacgagaagtacgggcacgatcgcgccgcacttgcggcagccgtatcgacctatcgcccgcgtggcgtgctgcgcgagaccggcaaggcgctcggtgtcgatccggtgctggtcgatcgcgtcgcgaaagcgcatcgctggttcgacggcagtcgcgacctgctgcagcaattctcgacgaccgggctcgatcccgagacgccgctcatccaggcgtgggcccggctcgccgcgcggctgctgaacttcccgcgccatctgtcgcagcactcgggcggcttcgtgatcagccgcggcaagctcacgcggctcgtgccggtcgagaacgcggcgatggacgggcggcgcgtgatccagtgggacaaggacgatctcgaagcgctcgggctgatgaaagtcgacgtgctcgcgctcggcatgctgtcggcgctgcatcgcgcgttcgacatgcgcaccgcatggcgaggcccaccgaaggctgacggcaagccgttcacgttgaagcacattccgaaggatgacgacgcaacttacgacatgatctgccgcgccgacacggtcggcgtgttccagatcgaatcgcgcgcgcagatgtcgatgctgccgcgcctgcggccgcgcacttattacgacctggtgatcgaggtggcgatcgtgcggccggggccgatccagggcggggcagtgcacccttatctgaagcgacgccagggcatcgaaaaggtcagttatccaaaggaggacctgaagcccgcgctcgaacggacgtacggcgtgccgatcttccaggaacaggtgatgcagatcgcgatgatcgcggccggcttcacggccggtgaggccgaccagttgcgtcgcgcgatggccgcgtggaagcgcaagggcaatctggagcaatatcacggcaagatcgtcgacgggatgcgcgagcgcgattacccgcccgagttcgccgaacagatcttcgagcagatcaagggcttcggcgattacggtttcccgagagccacgcggcgagcttcgcgaagctggcctacgccagcagctggctcaaatgccacgaaccggcgatcttcctcgccgcattgctgaacagccagccgatgggtttctatccgccgtcgcaactcgtgcaggatgcgaagcggcacggcgtgcaggtcctgccgatcgacgtcacgcaaagcggctgggaggcatcgctcgaagcgctgcccggccagccgcctccgcacggacagccggccgtccggctcgggctgtcgctcgtgagcggtctgggagaagccgctgtccgcaggatcgaagccgcacgcgcggcgggcccttcgacaacgtcgacactctcgcgcgtcgcgcgcagctcgagcgccgcgatctcgaggcgctcgccgccgcgaacgcgctcgcgaccctcgccggccaccgccgcgatgcgctgtggcaagcggttgccgcagcacccgagcgcgacctgctcgcgaccgccccgatcgacgaagcggagaagccggcactcggcgcgccgtcggaggccgacgatatcctcgccgactatcacaccaccggcctcacgctgaaccgccacccggtcgcgctgctgcggcccgagctgcgcgcgcggcggctgtcgtccgcggccgaattgcacgaccgccccgacggccggctcgcgcgcgcgtgcgggctcgtgaccgcacggcagatgccgggcaccgcgaaaggcgtgatgttcatgacgctcgaggacgaaaccggctgcgtgaacctgatcgtccggcccgagctgctcgcgcggcagcgccgcgaaaccctcgattcgcggctgctcgccgtgtccggcgtgtggcaggtcgcgagcgacgtgaggcacctcgtcgcgcagcatttcgaggatctgacgccgctgctcggcggcctgcgcacgtcgagccgcgagttccattgacgtgcgccgggtggcgccgccgccgaagcggccatggccgttacagcccgagcaatcgggccgcgttcgtgcgaccgatcctgacgcggtcgttgtcgctgatcaacgcattgtcgaaccagtcgctggcggtcgccatgctttcatacggatagtccgccgagaacagcacgcgttcgacgccgatctcgctgatcgtgttcaacaggcccttcgtatggaagtggccgctcgtcgtcacgtagaagttcctgccgaaatactcgctcaccgggcgtagcgcgctgccgagaccggcgccgtcgcgctgcatgtgcaaccggtgttcgagccgaggcagcatcagcggcaagccttcgccgagatggccgaggatcacggtcaggttcggataacggtcgaacagcccgctcagcatcagccggatcgcgtgagtcgcggtttcgtgcgcgaagccccacgccgagcccacgagcgacgcatagccttcatagatgcgccgctggccgggcagcggctcgcgcggatgcaggtagaccggcacgtcgagacgggcggcgcgctcccagaattcccaggccggtgcttcgtcgagatactgcgcggtatcggcgtcgccgatgtttgtgtagccgttgacgagcgcgcctttcatgccgagtgtcgtgaccgcgcgctcgagctcgtcggccgcgtcgcgcggcgcttgcagcgcgacggtcgcgaacgcatgcagacggccggggtgacgcgacgtgaaatgttcagcgatgtcgtcgttggtccgtttcgcgaaatcgacggccttggcgcggtcgaggatcgattgcgcgcccggcgacgtgagcgacagcacggcgacgtcgatgccacagcgatccatttcctcgatgcgcctgtccgcatcgagcagccgcgcgtcgacgtccttcatataaccctcgccgttgcgtgcggcttcgcccgacgcatcccactgtgcgttgttgcgctccgtcgtcaggtgttcctcgagaacgatcttgcctttcattgcgacgctccggtgctcagcgtgatgtgcttgtactcgatgaaatcatcgatcgcggcggcgccgttgaggcggccgagccccgactggcggtagccgccttcctcgaattcgtcgtagatcttggcccagtcgttgatccagaccgtaccggcctgcagcgcgtgcgacccgcaccgagcgctggacgtcgcgtgtccacacagcggcggcaagaccgtattcgctgtcgttggcaagggcgatcgcttcgtcttccgtatcgaatacctgcagcgtcatcacgggcccgaacgtctccttctgcacgatgtcgagcttcgggtcgtcgacttcgagcaatgtcgggcgatagaacgcgcctcgcgcgagtgccccgtcggtaacgggcccgcctcgcagcagcacagtcgcgcccgccgcgattgcctgctcgacggcgaggtcgacacgcgcgacattggcgcggtcgatgagcggccccatgtcgctgcgcgggtcggcggcgggaccgacgcgcaccgcggcgagacgctcggccagacgcgtgcgcaccgcctgcgcaacgtcgcgctgcacaagcaggcgcgagcccgtcatgcagaactggccggcgaacacggtcagcgacttttcgatgacgggcagcgcggcgtcgagatcgacgtcgccgaacacgacgtgcggcgtcttgccgccgagctcgaggccgaagcgcttcaggcgctgcgcaccggcggccgagatcgcgcggccggtcgccgtcgatcccgtgaagctgatgaccggcacctccggcgatgcgacgaggtacttcgcgccttcggcaccggattcgctgaacacgttgatgacgccgcgcggcaacgacggtgcttcggacaacaccttggcgacgagggcgttggtttgtgcggtctgcccgggcaatttgacgacggtggtcgtgccggcggcgagtgcgggcgcgagcgagcgcaccatcagcacgatcggcgaattccatggggcgatgatgccggcgacgcccatcggttcgcgcagcacgagcgacacgacgtcgggccgcggggtgccgccgtgagcacgctcggcacgtgcgagcgccgcgtagtagcgcagcttcgacggcaccatctcgacctcgaagcgggcttcctgcttgatcttgccgttctcgagcgcgagctgctcgatcagcgcctcggtatgccgttcgaacgcgacggcgagttcgtcgagcaccctggcacgcagcgcggcatcgtgcctccagggcgtgcgatcgaacgcgcgcgacgcagcggtgacggccgcgcgcgcttcggcttcgccgccgtcggcatagcggccgatcacggcgccggtggcaggatcgaacgaatcacgatgtgcgggcgaatcgatccattcgccgtcgatccagtgcaatgcatgagaagtggaagtcatgactttcccgttccggattcagaggtatcggtgagcgatgtgctcggccgctgcaatggtggtgatgttggtcgcgacagaaaccgcgtcaggaaaatcgatgcgtcgacgacgcgcaggttgcgcacgccgtgcacgcgggcgtcgaggtcgacgacggcatgcgcatctcccgcgacacccatcggcgcggtcgacgtggggtggtgataggtgtcgagggtcgatctgacggaggcgaggatctgctcgtcggttgccgctccagggccgggattcagctcggaatgaatcaggcccgacagcggtgcggtgcggccgatgcgacgcgccagccggatgccgtcgagcaggcgtacgcggtcccgctcgtcggcgaggaagttcaggtcgatgaccggcgcatcgccgggcttgcggctggcgagcttcacgctgccgaccgacagcggccgcgtcagcgcgaccgcgagcacgaaaccgactttggtcggactttgatcgtgcggaaacaggtgggttgcggtgacgtgcaggtcgaggtcgccgttttgcgcggacgcgctgcgggtcagaggaatgcgccgatcaccggcgattgatcgccgatcctgtccgggcgtgccgcgtaggcgttgtagtagaaggggtgatccttgagtcgttgcccgacgggcaggttcgcgacttcggggatcgacagcgcgcgcagatccgcgcccggcccgatgccggaccgcaggagaatcgcggcgctgccgtagctgccggcactcaggatcacttcgttcgcgtggatttcctcgccgctcgcgagcttgaccccgatcgcgcggtcgcgctcgaagagcacgcggtcgacgagcgcgtcgccgcgaatctgcaggttgccgcgcgcacggacatcgttggtcagataggcgatgcccgtgttgacgcgaacgccgttgacgatgttcatcgaatacggaccaacgccgttcgcgtccgggccgtcgaaatcgtcgacgatggggtagccgtttgcgacggtcgcgtcgacgaacgcgcgctgcatcggcgtgatgtcctcgcgggtcagctggcgtaccggcagcgggccggcatggccatgcagcgcggcgcttccgctgtcgcggctttcgagtcgcttgaacgacggcagcatgtcgtcgaatgaccagcccggcagattccagttcttcagatcctgcggccgagggcgaatggcgaccgcaccgttgatcgcggaactgcctcccagcaccttgccgcgcagcgcgccgatcgggtgatcgatgtagcccgtctgggtgcggtagccccactcgtggcgcgcatcgccgccgacgatgtcgctgctcgcgatcacgtgcggatagtcccacgcggcgtagttgtggccagcttcgagcagcagcacgttgcggctcgccttctcgctgaggcgcgcggccatcacggcaccggcggagccgccgccgacgatcagcacgtcgatcgtgcgtttaccgcttccggtctggcggcgggccgacgtgtcggtcggtgcgtcggcgggggccgcgatggcttcgccgccgagcagcgagccgacggcgagtaccgccgaatgcgcgagcatcgcgcggcgcgcggggtcttgcagggtagtgtcgttcacggtcgtgaatcctgtgtcgatgagtctcgaccagattacaaacgactgccatgccggcatagccggtggcaggtgaacgcggcgttcggttttggcgaacgtcgcgcccggcgacgacgggcgttacgcgtctaggccggccgagccggttgcaggatgcgccgttcgacgagcgcggtatcccagctggccggctgaccgatttcgtcgacgagaaactggataagtgtctggatcttcggcgacgtgcgaatcgcctttctgtacagcgcggaaatctggccgctcggcggagggtagtcgggcagcacgggcacgagatcgccggcgaggagcgcgtcggcggcgaggaacgtcgggaggatcgcgagccccaggccggccagtgcgccctccatcaattgatgtccggaatcggtgcgcatcctggtgcggatccggaacgactgcaacgcgtcgtcgacgggcaggctccacatgccgttgggctcgcggttcagatagatcagcccgtcgtgttgcgccagatcggacggatgcacgggtgtgccgtgccgggcgagatagccggggctggcgcaaatcaggtgatgattggcggtgagcgtacgcgcgacgaggttcgagtcggccagcttgccgatgcgtatcgcgaggtcgaaatggccgtcatgcagattggacagccggtcctccgcttcgatatccatgcagaggtcggaatagtgcgcagcgaagcgcgccaatagcggcgcaagctggcgcgtgatgaacgagacaggtgccacgagcctcaacgtgccgtgcaggcttgcgccggcgacctgcacgtccgcctcgattcgttcgagttcctgaagaagcggcccggagtgttcgaagtagcttcggccgggctcggtcagttgcagcggtcgcccgcgtttgagcaacgcacagccgaggcgtttctcgagctgctggacgcgccggctgacgatcgacttggtcgtgccgaggcggcgggcggcttctgaaaagctgcccgactcgacgacggccacgaaggtgctcatgtcggagaatttgttcatttctggtgcgggctggagatggctcgtctaccgggccgccttacccgccgcgccgggggcggtgtgcgcgcggagaaagcggatgccttcgtccagtgcgatttcgccatgggagtgattcgccttgtccttgaagaactggatgaaaccatgcgcctgcccgtcgtatacggtgacggccgcatgtgtgccggcttcgttcaggcggtgcgcataggcgatgctttcgtctcgtaacggatcgagctggccgacctggatcagcgcgggcggcaggcccgcaggatttcccgcgagcggtgcaagcagtggcccggaccgacgaattcccgtcggcacatagcttgcgagcacgttgtgcatcacggcacgggtcggaaaatgcgaatcgcccaattcggcccatgacggggtgttgctctcgaggctcacgaccggatacatgagccactgcgcgacgagtgccgggccattgcgatcgcgagccagcatggcggccgccgccgcgaggtttccgccagcgctgtcgccgcaaatggcgagccgcgccggatcgccgctgatcgacgacgcgtgatcgaaggtccattgcagtgcggcgtagacgtcctcgaggcccgcagggaacggaaattcgggggcgagccggtagtcgacggcaatcacgagcacgtgggcgcgaccggtgattgcgcgtgcgagtacgtcgtgcgtgtcgagatcgccggatacgaagccgccgccgtgcacgaacaggacgacggggagcctgtccgcaggctccgcgccagcgggcttgtacaggcgtgccggaatgtcccggtcgggatgccgggcgggtaccttgatctccagcacctgatccaccgcgtcgggtgtgccggctgatggaatcagcgcgcgataggaggtccgcatttcctgcacgaacgtcgcgatttcgtcggcgacgcgatgcggcgcggcagcgccgggttcgacgacgtggtgagccggcaggatgccggatagcgatttgctcaacggtttccacgacaacatgcattcactcctggtctggctggttcgacgccgtgcatcggggcgcgaagatagtaacggggcgtcgtcggcagcatcggccggttcgtcgtcagggcacgtcgctcgcgcgaatcgtcgaggccgctgcgatccggtcggtgaacgggctgcgcctgccttcgtgtcgtgcggacggagggccgtcattcgggcggcatggcgagcccggatgaatccatcaggcgaacgtcaggacgtccgacaccggcttgcgcggcttttgcggccagtttccggccgccggatggccaaccgtgacgagcatgacgggaacgtcggtcgcctcgaggccgaatgctgcggcgacgccgcgcgggtcgaagccgatcatcggaccggacgccagccccagttcctgcgcggccagcatcagggtcatcgcggccagcgagcccgaacggatcgcctcgtcgcgctggaacgtcgggttgtcctggtacatgtttcgtgccgcgcccacccagccgttgaacacgccttcgtcgatgatcccgacgtccagcgtcggtttcagcgcatcggcgagcgtcaggtgcggatcgagcgtgccgcacacgatgaacgtgacggccgcatccgcgactttctgctgcccgaacgcgagcggcagcaggcgagccttggcgtcgtcgctgcgcacggcgatgaatttccagttctgcagattgaatgcggacggtgcgcgcgtggcgagcgcgatcagctcgccgatctgttcgtcggacaacttgcggctggcgtcataccgattcgccgaaatgcgggacttgatcacatcggaaacgttcgacacttgaaaactcctttcttctttatgggagacggcaatgagcccatcggacaggcgccattctcagttactcaaatccgcaagggaactgactaaaatggaagtattgatctcatttttggaagggttgattggatctcaacgatgtccggatattcgtcggtgtcgtgcagacgggcagcctctccggcgctgccgcacggctgagcatgccgttgccgacggtcagccgtcgcattcgcgcactcgagaagcagctgtgcgtgcagttgctggagcggacggcacgcgggaccaagccgaccgaagccgggacccggctttacgaacacgcgagccggggcgtcgagatgctggcggagggcgagcaggcggtggccagcgacccggcgcgcctgaatgggcgattgcgcctgtcgctgccgcccgcgttcgatgtgtggtggacgctgttgtcggcattccagaagcgctacccggaaatccgcttgcatgtctatgccaccgaacgtcgcgtggatctgatcgaggacggcatcgatgttgcgttgcgggtgggggcgatctcgcacgaggcgatggtggcgcgcctgctgctcggctatcgccatgtcctcgtcgccagtcccgcgctgctcgacacgctgggcgtgccggaagggcctgacgacctgcatcggtttccgtgcgcggtgtggaatccggcgacccattcgaaccggggtggcgcttgggagagcgggacgtcgagctcgacccgatcctgtccaccaacgattacgcgtacttgcgaagtcgcgccatcgccggcgaggtcgtcaccgaacttccgccgtttctggccgccgatccgatccgggaggggcggctggttacgctgcttcccgcggatccgatgccggagcagcagatcaacctcctgtatccgtcgcaccggcatccgtcggcgatcgttcgcgcctatctcgagttctgtcaatcgcagcttgcgtggtttgcaagcgcctgtgccgtgggttgagacaggatcgcaggcaccggcggcgcggtgccggagcgtgcgcgcgatgcataccagttggctcaactggttctattccggtcgcatattggcactcgaaacctggctgagacgtgcacgggaactgtccccttgcataccaatccgggtaaatccctatcccgcatcgcgttgtaaacaaaggctttctcgctactaaaacgcttgccgggcaaggctttcggcgattttcgcgccgctaataccagttcgttgactggtattatggtggttatataatgccctcactttcgacggcctgcggtcgtcgtccgacacccggaggcacatggaaaccggctggtccgaactggcgcccgatccctcagcgatacgccgctctatctgcagctcgcccgcaacctggcgagcgcgatccacgccggcgcgtggcgggccggcgaggcgctgccgtcggagcggctgctgtcggtgtcggtcggcgtatcgcggatcacggcccgtcgcgcactcgcgctgctggtcgagcaggggctgatcaagcgggcgcgcggggcgggcagcttcatcacgccgcgcgtcgccgatccgctgtcgcgcctcgtcggcttcaccgcgaagatgaagcagcgcggcttcgtgcccgattcggtgtggctgtcgcgcacgctgcgcgccgcgagccgcgacgagatcacgcatctcggcctcgccccggcgcgacggtggcgcggctcgaacggctgcgccgcgcggacggcatcgtgatggcggtcgagcactcgacgctgccggccgcggtggtgcccgatccgcaggcgctcggtgcgtcgctgtacgagtacctcgacgcgcgcgggatgaccgtcgtgcgcgcgctgcagcactttcgcgcggcgaacgcgacccacgcgatcgcgaaatggatggcggtgaagccgggctcggcgctgctggtgatcacgcggatcggctacggtgccgaccagcgcgcgatcgaagtgagcgaaacgtattgccgcgacgattactacgacttcgtcgccgaactgaaacgctgacgcgcgagactcgcccgcgcgcgacagccgtgaagcaacgacacggaattgcaaatcacgacgcggatacccgcgtcaccagatcatcaagagaacgtcatgctgactggaaacatccttacccccgacggctggattcacggttcgctcgatagcgagaacggccgcatcacgacactcgacggcacgcccgtcgatcccgcgaagaacgacgcgccttacatcctgcccggcttcatcgacctgcacgtgcacggtggcggcggcgccgacgtgatggaaggcggcgacgcgatcgagacgatcgcccgcacgcacgcgcaattcggcacgacgagcctgctcgcgacgacgatgaccgcgccgcgcgacgaactgatgaaagtcgtcggcaatctcggcagcgtcgcgcgtacccgcacgccgggcggcgcgcgcgtgctcggcgtacacctcgaaggcccgtacatcaaccccggcaagctcggcgctcagcccgacgcggccgtctcggccgtgctcgacgaagtgctgaagtacctgtcgatcgcgccgatccgcgtcgtcacgctcgcgccggaaattgccggccacatcgagatcatcggcgagatggccgcgcgcggcgtgcgcgtgcagctcggccattcgctcgcgacctacgacgacgcggtggccgcgctcaagcacggcgcgtgcggcttcacgcacctgttcaacgcgatgtcgccgctgcatcaccgcaaccccggcctggtgggcgcggcgcttgctcacgccgaatacgcggaaatcattcccgatctgctgcacgtgcacccgggcgcgattcgtgcggcgctgcgcgcgatcccgcgcctgtacgtcgtgaccgacagcacgtccgcaacgggcatgcccgacggcgaataccggctcggcagccagcacgtgacgaagtgcctcggcggcgtgcgtctcgccgacggcacgctcgccggcagcacgctgacgatggaccaggcgctgcgcaacctcgtgtcgctcggcctgccgatcgccgatgtgtcgaaccggatgtcgcgttatgcggccgactacctcggcatcgccgatcgcggccgcctcgagcgcggcgcatgggccgacctcgcggtgttcgatcgcgacctgaacctcaccgcgacctacgtcgaaggagaatcgattgtcgaatatgcttaaggaagcgcgcgagtccgcccaggtcgtcgccgcgcagatcgccgacaccacgcgcgtcgaagcgctcgccggccaattgctcgatcacccgccggccgtcgcgctgacggtcgcgcgcggcagctcggatcacgccgcgagctatttcgcgagcctgacgatgagccgcctcggcgtgccggtcgcgtcgctgccgatgtcggtcgccacgctgcagcaggcgccgctgaaggtgcaggaccagctcgcgatcgccttctcccagtcgggcaagagccccgatctcgtcaacacgatggccgcgctgcgcgaagccggcgcgcgcaccgtcgcggccgtgaacgtgctgccgtcgccgctcgccgacgcgtgcgagcaccagctgccgctgctcgccggccccgaattgtcggtcgccgcgacgaagagctatatcgcgatgctgtcgctgtccgcgcagatcgtcgcgtactggcagcgcgacgccgcgctgatgaccgcattgcgcggcctgcccgacgtgctcgcgcaggccggccggctcgactggtcgcaggccgtcgccgcgctggcgggggtcgagcggatgatcgtgatcggccgcggcctgggcctcgcgatcgcgcaggaagccgcgctgaagctgaaggaaacctccggtatccaggccgaggcgttctcgagcgccgaagtccgtcacggcccgatggagctgatcgaccgcgactatccgctgctcgtgttcgccccgccggggcccgagcaggccggcctgctgcagctcgcgcaagacatgcgcgcacgcggcgccgcggtgctgctcgcggcgcccgctggcacgcccggcgcgaccttgccgctcgcgcagtctgcccattcggcgctcgacccgatcgccgccattctttcgttctacgtgatggcggcggatctcgccgtcgcgcgcggccgcaaccccgacacgccgcgccacctgaacaaagtcaccgaaacgcactgatagccgagacagccgatgagacgcgccgaggagtcccagttgaagagttccacccatgatcagatcgtcctgctcagtcccttgaccgggccgatcgtcgcgctggccgacgtgcccgatccggtgttctccggcgggatgttcggcgacggcatcggcatcgacccgctcgcgggccagctcgtcgcgccgtgcgcgggcgtcgtgtcgcatctcgcgcgcaccggccacgcggtgacgatcacgacgccgcaaggcgcggaagtgctgctgcacatcggcatcgacaccgtcgagctgaacgggcagggcttcaccgcgcacgtcgaggccggcgcgcgtgtcgaggcgggcgcgctgctgatcgagttcgaccaggacgcggtggcgcgcagcgcgcattcgctcgtgtcggtgatcgcgatcgcgaactcggatgcgttcgaggtcgtcgatcgtgccagcggcttcgcgacggccggcaagacgccgctgctcgcgctgcgcggcaagggcgaagcggctgcgcaggcggcacaaaccggcgcagcggcgcatcacgaagtgcgccgtgaaatcgtgctggcccagccgggtggcctgcacgcacggccggccgcgcgtgcgcgcgaagccgtgcgcgggttcgacgcgaccgtcgacgtgctgttcgacggccgcaaggcgtcgatcgcgagcgtcgtcggcctgctcggcctcggtgcgggcgaaggcgcgacggtcgaactggtcggccgtggcgcgcacgcgcagcaggccgtcgatgcggtcgagcacgagctgctgcgcgaagcacacggcgaagtcgaggaaaagccggcacggctgaggtcgcccgcgccgcagacggttgcgcgcaacgtcggcgcaccaatcgacccgaacacgctcgcgggcgtgtgcgcggcacccggcatcgcggtcggcacgctggtgcgtctcgacgatgcggagatcgtgccgcccgagcaggccgccggcacgcccgcgtcggagagccgccagctcgaccaggcgctgaaggccgtcgacgccgaactcgacgaaacggtgcgcaacgcatcggcgcgcggcgcggtcggtgaagcgggcatcttcgcggtgcaccgcgtgctgctggaagacccgacgctgatcgacgcggcgcgcgacctgatcagtctcggcaagagcgcgggtttcgcatggcgcgcgacgatccgcacgcagatcgacacgctgtcgaagctcgacgacgcgctgctcgccgaacgcgcggccgacctgcgcgacatcgagaagcgcgtgctgcgcgcgctcggtcatgcgaacggtgccgcgcgtgcgctgcccgacgaagcggtgctcgcggccgaggaattcacgccgtccgacctgtcgtcgctcgatcgccagcgcgtgaccgcgctcgtgatggcgcgcggcggcgcgacgtcgcatgcggcgatcatcgcgcgccagctcggcattccggcgctggtggcggtcggcgatgcgctgtacgcgatcccggacggcacgcaggtcgtcgtcgatgcgagcgcgggccggctcgaacatgccccgaccgcgctcgacgtcgagcgcgcgcggcacgagcgccagcgcctggacggcgtgcgcgaggagaaccggaaactggcgggggctgcggccgccaccgtcgacggccgcgcgatcgaggtcgccgcgaacatcgcgacgctcgacgacgcgaacaccgcggtcgacaacggcgccgacgcggtcggcctgctgcgtaccgagctgatgttcatccatcgccaggccgcgccgacggtcgtcgagcaccagcagagctaccagtcgatcgtcgacgcgctgcagggccgcacggcgatcatccgcacgctcgacgtcggcgccgacaaggaagtcgattacctgacgctgccgcccgaaccgaacccggcgctcggcctgcgcggcatccgtctcgcgcaggtgcgccccgacctgctcgacgatcaattgcagggcctgctcgcggtgaagccgttcggcgcggtgcgcatcctgctgccgatggtgaccgacgcgggcgagctcgtgcgcctgaaaaagcgcatcgacgaattcgcgcgcgcccagggccgcaccgagccggtcgaggtcggcgtgatgatcgaggtgccgtcggccgcgctgctggccgaccagctcgcgcagcacgcggatttcctgtcgatcggcaccaatgacctgacgcagtacacgctcgcgatggaccgctgccaggccgacctggccgcgcagtccgacggcctgcatccggccgtgctgcgcctgatcgacatcgcggtgcgcggtgccgcgaagcacggcaagtgggtcggcgtgtgcggcgcgctcggcggcgatccgctcgcggtgccgatcctggtgggcctcggcgtgaccgagctgtcggtcgaccccgtatcggtgccgggcatcaaggcgcgtgtgcgccgtctcgattaccagttgtgccgtcagcgcgcgcaggatctgctcgcgctcgattcggcacaggcggtagggcagcaagtcgcgaggtctggccgctcgactgagcgtcgacggcaggttcgcgacccgtattacgacgaaggcaatcagctcaacgacgattaacgacgcttaacgacgagacaaggattggaggactgaatgaacgggaatccgtttctgaaaatacagggcctgggccgggcgctgatgctgccgatcgcggtattgccggtcgccggcatcctgctgcgactcggccagccggacgtgttcaacatcaagatgatcgccgacgccggcggcgcgatcttcgacaacctgccgctgctgttcgcgatcggcgtggcggtcggtttcgcgaaggacaacaacggcgtggcggcactcgcgggcgcgatcggctacctgatcgaaaccgcgatcatgaaggacatcgatcccaagctgaacatgggcgtgctgtccgggatcatcgcgggtgtcgtcgcgggcctgctgtacaaccgctacaaggacatcaagctgccggactacctcgcgttcttcggcggcaagcggttcgtgccgatcatcacggggctggtgtgcgtggtactcggcatcgcgttcgggtacgtgtggcagccggtccagcatgcgatcgacgcggccggccagtggctgacgacggcgggcgcgatcggtgcgttcgtgttcggcttcctgaaccgcctgctgctcgtcacgggcctgcaccacatcatcaactcgctggcgtggttcgtgttcggcaacttcacgccgcccgccggcggcgagatcgtgcacggcgacctgcaccgcttcttcgcgggcgacccgaccgcgggcaccttcatggccggcttcttcccgatcatgatgttcggcctgccggccgcgtgtctcgcgatgctgcacgaggcaccgaaggagcgccgcgcgatggtcggcggcctgctgttctcgatggcgctcacgtcgttcctgaccggcgtgaccgagccgatcgaattcagcttcatgttcctcgcaccggtgctgtacgtgatccacgcggtgctgacggggctgtcgctcgcgatctgccagatcctcggcgtgaagctcggtttcacgttctcggccggcgcgatcgactacgtgctgaactacgggttgtcgacgaagggctggatcgcgatcccgctcggcatcgcgtacggcgccgcgtattacgggctgttccgcttcttcatccgcaagttcaacatggccacgccgggccgtgagccggcatcggccgacgcggccgcggaatcgtacgcatcgggcggcttcgtcgcgccggcggcgggcgccgctgcggctgcgccgcgtgcgcagcgctacatcgccgcgctgggtggagccggcaacctgtcggtcgtcgacgcatgcacgacgcgcctgcgcctgaccgtcgtcgatccggagaagatctcggagccggaactgaagtcgatcggcgcgcgcggcgtgctcaagcgcggcggcaacagcgtgcaggtgatcatcgggcccgaggcggacatcattgccgacgagatgcgtgccgcgatcggcagcggcgcgaccggtgccgcgtcgacggcgacggccgccgcggcgcagcccgtcacgggcgcggccgccggtccgctcgatccggagccggcgcgctggctcgcggtgttcggcggcgcgaccaacgtcgtgtcgctcgacgcgatcgcgaccacgcgcctgcgtgtggtcgtgcgcgatccgtcggcggtcgatcgcgatcgtctcggtgcgctcgacgtcgcgtgggtgtcgctcgacacgttccacatcgtctgcggcaatgcggcggcacgttatgccgaacagctcggcgcgcgcctgccgccgtcgggcagcggagcggccgcgcagccggcctgatgtgatcgggccggcccgatccgcgacgcggattcggcccggccggcaaaacgaaaacggcttgcgatccttgcgtcgcaagccgtttttcttggtgcgggcgatggcgcgatgcacgtgtttgcatcgcgcgtcgcccgggcgttcagccgatcacggattcgtcagcgtgaaggtcggcttccggtagccgacaccggcccggtcgagcttcggcaattcgcgttgcgtgagcagcgtcgcgaaaccggcccagtcgcgctgcagcgcggccgtgtcgacgtgatgcgtgtcgccgcgcttgaagcgcacgccggccgcatacggcagttcccagtcggcgcggtgccaggcgcgctcggcgagcgcgagcagccgcggataggccatgtattcgaggaaggtgccgttgcgcatcacctcgccccatgcctgcccctgcatgccttcgatgcgcggcgcggggcccgttcccgtgacctcgaacgggttgccgtcacggtcgcccatcacttcggcgttctgcggcaggttctccggtgcgagcgagaacaccttgtactcgtccgtcgcgtgcgagccccagtagtagccgcgctcgcgcgggttgagcgtgtacgggaagtcgaagtacaggtagtcgggcagcgcgagcaccgtcagatagcccttgccgctcaggtcgcgcgcgctgtccgacgcccccagaagatcgtgtcccacagcgacaccatcacgtggcgcgtgctgaagtcctgcggcccgttcgcatgcttgatgccgtcctgccacgcggccatcgtgtcgatcccgttcgcgccgaccgccgcgctcacctgctgagcgaaacgcgtcggcagttcgtcgatcgacttgatctcgccgcgctggagcaacgccgtgcatgcgggcgaacgcgcccacggcttgtcctgcgcggcgagatcgatgcgccccttgttcggatcggtgccgttcagcggctggaagcccgcgccgaggaagatgttcttcgcctcgtcgccgccgtaatgccagatgtgcagcggcgcctgcgcatccgcatgcatcgccgcgatctcgcggatcaccttcgatgcgaaattgagcgcgcccggcacgcacgggttcaggtcgctgcggcggtcgtagaactgcaccgtcgtcaggttcgacgtgtcctgcggatcgagcagccggtatgcgttcgcttcctgctcgcgcccggccgcatgcagccgccggtaacgtgcctccatcgtcacgacggccgcgcgcgcatgcgcgggcatgtcgatctcggggacgatctcgacgaaatgcgcggccgcgtagcgcacgagcgccacgtagtcgtcgcgggtcaggtagccgccgcccgagcggttgtccgggccggagccgagctgcggcagcaggcagcgcgtctcgctcgggtcgtggcagcggcgcgagccgatcccggtcagttcgggcaggccgggaatctcgatgcgccagccttcgtcgtccgacaggtgcaggtgcaggcgattgagcttgtacgcgctcatctggtcgatcaggcggcgcagcgtcgccgggtgcttgaagttgcgtgcgagatcgacgtgcatcccgcgatgcgtgaagcgcggcgcatcctcgacgagcatcgccgggatcaggccgccgccggccggtgcgagcgagtagagcgtctgcacgccgtagtagaggccggcgcgatcgtagccctcgatcagcacgccgcgcggcccgatcgcgagccggtagccgcccggcgtcgcgatgtcggccggcagccggcgcggcgcgacggcgccccgcaccggcacgcgcgcgccgtcgagcccgagcgtcgtcgcacgttcgcgcagcgccgcgacctgcgcgtccggcagatcgggcagggcgagctcgacaccgcgcagctcgagcgtgccgggcagcggctgctcgcgcttcacgctcggcagcgcgcggctcgggtcgggccgtgcggccacgggcggcgcgttgcccgtcgagttgttctgcgcgtcggccggcagcgattcgacgtagcgcagctcgtcgtcggtgtcgtcgtagcggagcacggcgggcggcgcgccctcgacgaccacgtacgggcgcgggatcacgtcgctgtagcgcagcagccagtattcggcgacgaacggcagttcgatgcgttcgcccggtgcaagccgcaccgagccgggttgcggtgtcagttcgtacaggtcgccggtgagccgccgcagcgcgaagccggggcgatcgattcgcagcaggcggcggatgctgtgcaggtagagcttccagccgccgtcggcgatcgcctggtggccgcggttctgcaggatcaggcggcccgtcgcgcaggccgcgccgtcggcgccgagttcggcgcacggcacgccggccgaggccgcgtgattgttgtcgacggcgacgcgcagcgcgaggccgttcgacagccgtgccgcgagatcggccggcggcacgggggacggacggcaccggccgccgcgaccgccgcactcgacgcgggcagcgcgccaagcgcgaccggcggcagtgccgcgatcagcacgccggcaaacatggtggacaaggttcggctcatgcggactcctgagaaaaagggggcgtagcggcgtcacgggacgacgtcgctgcgggcgggtctttcaacggagctgcggggacaacaatgtgcgcgggcgatgcggctgccctgcgcgcagtcggcacgcggacgcgtgcgttacggaacgggcggcgggcaggcgtgccggtcggatcggcgcgggcgggtgcgtgtcctcatcggccgggcacgatggcggccgcggatgacgctgaccctgacgcggtggcgacgcgcccggtgataaaggcgcgcgcgcgagcggcgcggacggcggcggcgcaggtcgcggacgaagcgcaaccggccgccgcgcggcgacggcgagacggcgcgcgcgcgcgcgcgcatacgggattcgcatgtctccccacccagatggattcggcctgtcagcggccgtgtccaaagatcttatgaaaccttttattggtattcaagtggtatcaatctggcgctaaattggcatcggcgtgtccggcctgcccggcgtgtcggagcgaaaaaacctcgcgcgaggcgaggttccttccggacggcggccggccgatcggccgaacgcgtcagttgcgggttacgcgtgcttcctgcgtcttctgccgcgcttcgagccacatcgcattcacgatgccgaacgacagcgcgacgccgataccgagaatccagctgaaataccacatgatccgactccttgcgaaacgggcggcggcgggcgcctgcgcgccccggccgggttcaatacatcgaatgcttgttctcttcgagcacctcgcgcgtgaccttgccgcgcatcacgcgatacacccagctcgtatagagcaggatgagcggcaggaacacgatcaccgcgaacagcatcacctgcagcgtcatgtggctcgacgtcgaatcccacacggtcaggctgctcttcggatcgagcgacgacggcatgatgaacgggaacatcgagaagccggcggtcaggatcacgccgacgatcatcagccccgtgcagaagaaggctgtcttctcctgcttcgagccggcgagcagcatcgccagcaggccgcccgcgatcccgacgacgggcgccgcgatcatccacgggaattcgccgtagttcgcgagccacaggcccgagcccgcggcgacgtccttgagcagcgggttcgcgaccgtatcggtcggcgcggcgtgcgtgatgtggaagccgccgatggtcgacgcgatcagcacgccggccagcacgaacagcacgacggcgaggaacgacgccacgcgcagcgcgaccgacgcgcggcgtgcgatcacgccttccgtcttcatcttgatgaaggccgcgccgtgcgcgacgagcatcgtgaggctgacgagcccgcacagcagcgcgaacgggttcagcaacgcccagaagccgccgtagtaggtcacgcgcaggtcgctgtcgaacttgaacggcacgccttgcagcaggttgccgaacgcgacgccgaacacgagcgccggcacgaaaccgccgatgaacaggccccagtcccagcccgcgcgccagcgcgggtcagggcgcttgctgcggtagtcgaagcccaccggccggaagaacaacgcgaacagcacgagcagcatcgcgaagtagaagccggagaacgacgccgcgtagacgagcggccaggccgcgaacatcgcgccgccggccgtgatcagccacacctggttgccttcccacgtcgcaccgacggtgttgacgatgatgcggcgttcctcgtcggtcttgccgaggaacggcagcagcgcggtcgcgcccatgtcgaagccatcggtgacggcgaagccgatcagcagcacgccgacgagcagccaccagatcagcttgagagttgcatagtccatagcgattccttgttccgtttcgggtgcgtgctcaggccgtggcgcgctcgctggcggccgcgagttcgtggtgatagcggccggtgtgcagcgacgacgggccgaggcgcgcgtacttgaacatcagcttgatctcgatgacgaacagcgcggtgtagaacgcgatgaaaccggcgaggctcaggtacaggtccgtcgacgtcaggctggacgcggacagatgcgtcggcaggatgcccgcgatcgtccacggctggcggccgagctcggcgacgacccagccgaattccgcggcgagccacggcagcgggatcgcccacaccgcataacgcaggaaccagcggcggttgtcctgcagcagctgccggcgcgcgcagagccagaacgcggcgacgaaggtcgcgaggaacaggaagccgaggaacaccatgatccggaacgagaagaacacgggcgcgaccggcgggatcgtcttcttcgcggcggccttgatctgctccggcgtcgcatcgaccacgttcggcgtgaactgcttgagcatcaacccgtagccgagatactgcttgtgctggtcgaacagtgcgcgggtcgcatcgctcgtgtcgccttccttgatcttctgcaatgcgccgtacgccaccatcccgctctggatgtgctcctcgctgcgcttcgcgagttcgcgcaggccgatcaccggctcgtcgatcgagcgcgtcgcgatcaggccgagcgcgtacgggatcttgatcgcgtagtcggtgcgctcttccttctggttcgggatgccgatcagcgtgaacgaggccggcgccggctgggtttcccattccgattcgatcgcggcgagcttcatcttctgcacttcgccggtcgtataacccgactcgtcgccgagcacgatcacgcaaagcgtcgacgcgagaccgaagccggctgcgaccgcgaacgagcgcagcgcgaagtcggtgtcgcgcttcttcagcaggtaccacgacgagatgccgagcacgaacatcgcggccgtcacgtagccggccgacacggtgtgcacgaacttcacctgcgcgaccgggttgaacagcacgtcgaacaggttcgtcagctccatgcgcatcgtctggtagttgaactcggcgccgaccgggttgttcatccagccgttcgcgacgaggatccacagcgcggacaggttcgagcccagcgcgacgaggaacgtgaccatcaggtgcttgaccttcgacaggcggttccagccgaagaagaacaggccgacgaacgtcgattcgaggaagaacgccatcaggccttcgaccgcgagcggcacgccgaagatgtcgccgacatagtgcgagtagtacgaccagttcgtgccgaactggaattcgagcgtgatgccggtcgtcacgcccatcgcgaagttgatcccgaacagcttgccccagaactgggtcatgtccttgtagacctgtttgccggtcatcacgtagacggcttccatgatgacgagcagccaggacaggccgagcgtcagcggcacgaacaggaagtggtagagcgccgtgatgccgaactgcagacgcgacagatcgacgacttcgctacttatcatggtggtctccctcggtgggtgcaggcgccggcaccgagagcagcttctcggcgacggcggcaggcggaagcgacatgtgctcggcctgcggatgattgaagaatgcgtatttgagcgacatcaggaggatcagcttgacgatcagcaccaggctgatgtcgcgggcgagggtcgggccgcgtgcccatgcggcgatgcgcgcacgccagccgatcgtgccggccggccgcggggaggcggcgcaggctctttattgatcgagatcaaggcgattatcctgaatcgatttacgtcggattgggggcgactttacgtcggatttatgacggccgtgaagctgttttaatcctttgcgcctgacatgccaattttaaaaggactgctttccgatgccgagtgctgcgctgcggcagaccgtcgcgaaacacgggccgaaacttgaggcagatcaaggttatgcggaaggggcccgcgaaccgtccaatacctgattaaacaggtcaattgatcgacggagaaatgagcgaagaagcgggcggagaggcgagggataaaccggctaaaaaccggtgaaaaagtcgggcgaaaaaaccgctgccggtcaggcagcggttttcgacgaagctttcgaatcgccggtatttatgcgtattcggcgagggcggtgcgcatcttcttcatcgcgctcgcctcgatctggcggatgcgttccgccgacacgccgaactcggcggcgagatcgtgcagcgtcgagccgcccgagccgtcgtcgtcgacatgcagccagcgtgcctcgatgatgcggcggctgcgcgcgtcgagcgcgtcgagtgcctgcgcgatgccgtccgtctgcagcgagtcgcgctgacgcgcggcgagcacggcggtcggttcgttgtgcgagtcggccaggtaggcgatcggtgcgtacgactcctcgccgtcttcgacctgcccttcgagcgcgatatcgccgcccgacaggcgcgtttccatttcggtcacgtcttcgcgcttgacgttgagctcttgtgcgaggccgtcgatttcctcgggcgtcatcgcctgcatgctcttcttgtggctgcgcaggttgaagaacagcttgcgctgcgccttcgtcgtcgcgaccttcaccatgcgccagttgcgcaggatgtactcgtggatctcggccttgatccagtggatcgcgtacgacacgagacgaacgttctgggccggatcgaagcgcttcacggccttcatcaggccgatgttgccttcctggatcaggtcgccgtgcggcaggccgtacccgagatagttgcgcgcgatcgacacgacgagccgcaggtgcgacagcacgaggcggcgtgccgagtcgagattgttgctttcgcggaattcggtcgcgtactggcgttcctcttctgccgtcagcagcggaatgcgattgacggcctggatatacgcgtcgatgttgccaagctggcccggcaacatcgattgagctgcgagcgccagcgagcctgccgattcggccttggccggcgccgggctcagggtgttcgggagggtcagggcgttgctcactaaaaactcctttggaatcagggacaaaccccggtctcgaatgagattccgtggggcatcttagcactcccgcaagctgagtgctaattccttagagcaagcgtgggcatcggagttcccgtttttctatcgagttagtcgagtcgatagtctattctgcgacagggaggcgacgcgaagttccgtaagccgttgtttcagatggtaatcagtagacgatttcaatttttgttgttttggaaggaagccatttcgcttcgtgatgccgatccgaaaagtcctttaccataccattcacttcgctcgagccggccgaagcggcaggttccattcaacccacaaagttggagtgtcagatgaacaataagaagaatcgccggccccgcagccggcttgtcctgcacgcgatgctggcggcgtcccttctgggaggatcgggtgcggcattcgcggatcgatggggattcaggcgggcggcggttttcggatcgccacggggtcgacaagggcgatctcggcgtggtgtgggatccgggctggaactggtgggaaatgggcggttggcacttcgcgttcgtcgtggaagggcacgccggctactggcacacgggcggcaatgttcacggcagcatcggcgaattcggcgtgacgccgttgttccgcttcatcaagagcgccgggagattcgcccgttcatcgaggctggcggcggcgtccggctgctgacgcacccgacgatctcggatcatttctcgctggggaccgcgttccagttctcgccgaccgcgggagtgggcgtgcagttcggccaacggcaacagtatcaggtcggctaccgttttgaacatgtgtctaacgcgggtatcaaagagccgaatcctggtataaatttccaccagttctacgtgcagtacaacttctgatccgcacgcccgcgcacggcgtgcgcgttgccgaggagtcaggcgatggcgaaggtgatcgatgcgatccgcgcgctcgagcgcgatcggttccgggcgatggtggacggcgacggcgaggcgctcggcgcgcttttgtcggacaaggtgttcttcgtgcacaccaacggcaaacgcgaaaccaagcagcagttcatcgacgccatcgtcgccggccgccgccgctatcgccagatcgaaatccagtcgcaggacgtgctgccggtcggcgatgaaacctgcgtcgtcaccgggcgtgcgttgatcgagatggaaacgaacaacggcggcctggtcttcccgattgcgtatacctccgtccacacccatgaacagggccgctggagcctgttcgcgtggcaggcgacgcggtgcgcgaccgagacatgagcgcgcgtggcgcccgttttcatgtcccgatcgaagcggccttctgggccgcttttgctgcctcgtgcggcgcggatcgcgcggcgcacgagcggtcacgcaccgctcgctgacgtttgaaccctgaaacggaaccgtccgtcaggccgccgcgcggcgatccgcgcagtgccaggccgagcggttgatcgcgctgacgagcgcatcgagcgcggcgcccgccgcatcggcgtgcaggccgacgccgtgccgcagcggcgcatcgccgacccggcagcccaccgataccgcgatccgcccgtccgtcgtgcgcgcgtgttcgcacgaagcgatgtcgatcgcgacgccggcggcggctgcgaatgccgcggccaaacgtcgcacggcatcgtcgggtgcgatatccgccgcgggcgccgtcgcgatctcgcggttccgccagcgcgcgccgttgccgtggcgcgcggccgggccgtcggtgtcgaagaattcgcgcgcgaacagcgcgcagatcgcgtcgcccgtcacttcctctcccgacgcgtcggcaagcgtctgcaccgcgtggctgaattcgatctgcacgcgccgcgtcggcgtgaagcccatcccgcgttcgagcaggaacgtcgcgccgcccttgccggactggctgttgacgcggatcaccgcgtcgtagctgcggccgaggtcggccgggtcgatcggcaggtacggcacttcccacggcgcgtcggggcgctgctgcgcgaagcccttgcggatcgcgtcctgatgcgaaccggagaacgcggtgaacacgaggtcgcccgcgtacgggtggcgcggatgcaccggaatctggttgcagcgttcgacgacgcggcgcaccgcgtcgatgtcggagaaatcgaggcccggatcgatgccctgcgtgtagagattcagcgcgagcgtgacgagatcgacgttgccggtacgctcgccgttgccgaacaggcaaccctcgatgcggtcggcgcccgcgagcagcgcgagctcggccgccgcgaccgccgtgccgcggtcgttgtgcggatgcacggacagcacgatgctgtcgcgatacgcgaggttgcggtccatccattcgatctggtcggcgaacacgttcgggctcgcggcttcgacggtggccggcaggttgacgatcatcttgtggtcgcgggtcgggcgccaggtttgcgcgaccgcgtcgcagatctcgcgtgcgaacgtcagctcggtcatgctgaaggtttccggcgagtactggaaggtccactgcgtgtcggggcgcgcggcggcgtgctccttgatgatgcgcgtgccgtcgatcgcgagcgccttcacgtcggccttcgacatcccgaacacgatgcggcggaacgacgggcagaccgcgttgtacaggtgcacgatcgcgcgcggcacgccttcgagcgcgtcgaacgtgcgtgtgatcaggtcttcgcgcgcctgcacgagcacttcgatcgtcacgtcgtcgggaatccgcttgtcgtcgatcagcttgcggacgaaatcgaagtcggtttgcgacgccgacggaaaaccgacttcgatctccttgaatccgatcgcgaccagcatctcgaagaattcgagcttctgctcgatgctcatcggctcgatcagcgactggttgccgtcgcgcaggtcggtgctcatccagacgggcgcgcgctcgatggtgcgcgacggccatttgcggccattgaggcggacgggctcgaacggacggtacttgtcttgcggattgcgctgcatcttctggacctcgggtctcaagtcgcgagcgaagacgggcggcatgggcgacggttggcgctgcctcgctccgcggcacgcgagcgcgctgcggatgcggatgatcttcgcgaatcggccgacggatagacggacgaatgctgacgacttcgggttgtaaaaactgcgagaggggtactgcgaggaactgctgggagggaccgtgcggacagcacacggcgctacgacagccttaggctagtcgtagcgatagcggccgcgctaggcggccggaggtaattcggagggtgttcggaaaggaacgcatgacggcaactctatgccaggatgcgcccgcgtgtcaaatgcccggcgcgcggggccggttcgcgggcgtgccgtcagcgcgcgatgcgggtgatctgcacgatcgtcgcgacctggcgggcgacggtgtcgggcaccggcacctcgccgcgcaatacggcgtccgtccacgcggccgtcgtggccgcatcgcgcgattcgggcagggcgacgggggcgcttcggtcgacgagcgctcggcctcgatcagcgtgtcgcacacgccgtcgtgcagccagtcgacctgcacctggcgccgcgtgtcggcaacggcttcgccctcggtgccgcgcgcgagcagcgcgccgccgagcgcggcgtcgggatggtcgcggaacagctgcgcgaggctgtcgcggtacggcgggtgcgtgtagttgacgagccgcaggccggccggtgcgaacggctgcaggatcttcacgagcgtgtgcgtcgaattgcgcacgccgagcacgcggcgcatcgacagcaggcgtgcaatgcgcggcgccagcacctcgatcgacgcgaacgcgacgcggcgctcggcaagcgtgtcctcgatcgcatcgtgcgacgccgacggcgcaagcgacagcgccgagaagatctcggcgctcgtcacgcggcccggatcctgctcgacaccatgcacgagcaccggcacgccttcgcgcgcgagcagcagtgcgagcagcggcacgaggttcggctgcttgcgcgcgccgttgtagctcgggatcgcgacggggcggaacgccgcgtcctgtaggtgcacgggttcgaacgacgcctgcgcggcggcgagcatcgcggccagctcgtcggcggattcgcccttcagccgataggcgatcaggatcgcgccgagttcgacatccgacacgcgcgcgtcgagcatcgcgcgatagagctcgaacgtgtcctcggcggacagcgcgcgtgcgccgttcgggccgcggccgatttccttgatgaagcgggcgcacgggaacggaacggcggcgggatcgtgggaagcggtcatcggggcgtggggcgggcggccggcatcgggccgcgctgtgagcggtgaggaatgcccgagtatcgcacgggcgcggacgacgcaagcaagggggcgcatcgcggcgcgctacactctgcttcccggcggtgcgcgcgccggctgcgccgcgcccgtgccgttgccggccgaatacgactacgagagacatcccatgaagctttacagctatttccgcagttccgcgtcgtaccgcgtgcggatcgccctgaacctgaagcagctgccgttcgactatgttcccgtgcacatgctgcgtgacggcggcgagcaactgaaggacgcgtaccgcgcgctgaatccggacgcggtcgtgccgacgctgaccgacggcgacgcgacgctgcagcagtcgctcgcgatcatcgaatatctcgaggaaacccatccggaaccggcgctgctgccgaagcagccggtcgatcgcgcctatgtgcgtgcggtcgcgctgcagatcgcgtgcgaaatccatccgctcaacaacctgcgcgtgctgaagtacctgaagcacacgctgaaggtgcccgaagaggcgaagaacgcgtggtaccggcactggatcgaggcgggcttcgaatcgctcgagacccggctcgcgagcgatccgcgcaccggcaagctgtgtttcggcgacacgccgacactcgccgacgtgtgcctcgtgccgcaggtgttcaacgcgaaccgcttctcgatcgaaacgacgcgctatccgacgatccagcgaatcgtcgaccatgcgtcgacgctcgatgcgttcaaggccgccgagcccggcgcgcagcccgacgccgaatgagcgcggtgcgcccggcatgcatgaccgggcgcgcatgaaaaagggcgcccgaaggcgccccgtacgatgcgtgccggcggtgttcagccgagcagcgcgtccgcgaattcgaccgcgctgaacggctgcagatcctcgaccttctcgccgacgccgatgaagtagaccggcaccgggcgctgccgcgcgatcgcggcgagaatcccgcccttcgcggtgccgtcgagcttcgtgacgatgaggccggtgaggccgagcgcgtcgtcgaatgccttgacctgcgtgagcgcgttctggccggtgttcgcgtcgatcaccagcagcacttcgtgcggcgcgccgtcgtgcgccttcgagatcacgcgcttcaccttcttcagctcttccatcaggtggagctgcgtcggcaggcggccggccgtgtcggccatcatcacgtcgatcttgcgcgcgcgcgcgcgctgaccgcgtcgaagatcaccgcggccggatcgccgctttcctgctgcacgaccgtcacgttgttgcgctcgccccagaccgccagctgttcgcgcgcggccgcgcggaacgtgtcgcccgcggccagcagcaccgactggtcgaagctctgcagatgctttgcgagcttgccgatgctggtcgtcttgcccgcaccgttcacgccggtgatcatcatcacgagcggctgcgcgcggccgagcatcagcgacttctcgagcggcgtcagcaactcgacgagcaggtcgtgcagcgcggctttcacctgctgcgggtcggtcaggcggcccgcgcgcacctttcgcgtagcgcgccgagcaggtactcggtcgcgtcgacgcccgcgtcggacatcagcagcgcggtttcgagctcctcgtacagatcctcgtcgatcttcgtgttgacgaagacgccggtgatgctcgagcccgtcttggcgagccccgttttcaggcgggcgagccacgatttcttcgcggtggcgtcctgcagcggcggcggaacgatttcgaccgtctcgacgacttcgtcgcgcccgtcgttggtcggcgtgaccgtcatcacgacggccggcgcggccggttgcgcgggcgcttgcggcacttcggccgcaggcggggccttgaccgcgggcgcatcggacggttcgtccgtttgctgcgcgtcggccgattgcgattccgccggatcgggctcctgcgttttcttgaatcgtttgaagaagctgaacatggtctgacgtcgggaagagggcgggccgccgccggaagcggggcaccggacgggccgtcctgcgttcgcgcgggcgcggcgcacggcggccgaaaccgtgcattttatcagtgcggcgtggcgctcgcgtcagtgcgcgccgccgctgtggtaacgtgcgcctgtttggcggtgcgcccctgcgcgcgcccggtccctccgtcgtcgatattccgtatgtcccgttcctcttccggccgcccggcggccctccagccgcggcaagccgcacacgatccgcatcatcggcggcgactggaaacgcacgccgctcgcggtgctcgatctcgacggcctgcggccgacgcccgatcgcgtgcgcgaaacgctgttcaactggctcggccaggatctcgaaggccggcgttgcctcgacctgttcgcgggcacgggcgcgctcggtttcgaggccgcgtcgcgcggcgcggcgagcgtcgtgatggtcgagcgccacccgcgcgccgcgcagcagctgcgtgcgatcaaggacaagctcggcgcgcgtgcggtcgaggtcgcggaggcggacgcgttgcggctcgcggccgggctcacgccgggcgcgttcgacgtcgtgtttctcgatccgccgttcggcgaaccggctgtgctcgatcgcgcggtcgcgctggcggcgccgctcgtcgcggcgggcggcgcgctgtacgtcgaaacgggggcggagctcgacccggccgcgcacgatgcgctcgcgggctgggaggtggtgaagcacggcaaggccggtgcggttcactatcatttgctgcggcgcgaaaatgatgaataatgcgcgttccatacgaggcggcgcgctgcaaaggcgacgcatgcccatctcggcagtcgcgtgcgcatggcaccgctgccatcccgtttgcgtgatgacaggaggagcgacatggtagtcgccgtgtatcccggtacgttcgatccgctgacgcgcgggcacgaagacctcgtgcggcgtgcgtcgagcatttttgatacgctggtggtcggtgtggccgacagccgcgcgaaaaagccgttcttctcgctggaagaacgtctgacgattgcgaacgaggtgctcggccattacccgaacgtgaaggtgatgagtttcaccggcctcctgaaggacttcgtccgcaccaacaacgcacgcgtgatcgtgcgcggcctgcgcgccgtgtccgatttcgaatatgagttccagatggcggggatgaaccgctatctgttgcccgacgtcgagacgatgttcatgacgccgtccgaccagtaccagttcatctcgggcacgatcgtgcgcgaaatcgcgcagttgggcggtgatgtcagcaagttcgtgttcccgtccgtcgagaagtggctgaccgagaaagtgacggcgatgggaggccctgccgcgtgacgcggcgccggccggtttcttcgcgaagccggccgccggcctgaagaagtgagatcagtatggctttgatgattaccgacgagtgcatcaattgcgacgtgtgcgagcccgagtgcccgaacggcgcgatttcgatgggcccggacatctacgtgatcgacccgaacaagtgcaccgagtgcgtcggccatttcgacgaaccgcagtgccagcaggtgtgtccggtcgaatgcattccgcgcgatccgcagcatgacgaatcgcacgcgcaattgatggagaagtatcacgcgttgatcgccgtgaaaggcgacgacgcgtcgtgacccgcggtgacgcgcgcgcccgggtttttcggcacgcgcgtcacgcatccggatcggcgccgcctggcgccgattccttcatgtcaggccagcagctcgcgcaacgccgcgacgagcgcatcgcattcggcatcggtgccgacggtgatgcgcaggtgctggtcgattcgcggcagcccgaagtgccgcacgaaaatttcccgttccttcagtttggccgcgatggcgcccgcgtcgtgcgcgggatggcgcgcgaacacgaaattcgcggccgacggcacgacgtcgaagccgagcgtgtcgagcgcgtgcgtgagccgcgtccggctgtcgatcacgcgccggcaggttgcgctgaaataatcggtgtcttcgtacgccgcctgcgcggcgacttgcgcgagccggtcgagtggatacgaattgaagctgtccttcacgcggttcagcgcgtcgatcagcgcggcatcgccgaatgcgaaaccgacgcgcatgcccgcgagcgagcgcgccttcgacgtcgtgtgcacgacgagcaggttcgggtagcggtcgattagcgcaatcgcggactgcgcgccgaagtcgacataggcttcgtcgatcacgacgaccgacgacggattcgcggccgcaatccgctcgacatccgcgagcggcagcgcgcgcccggtcggcgcgttcgggttcggaaacagcacgccgccggcgtcgtcgagatagtcgtcgacgcggatcgagaagtcatccgcgagcggcacgaccgtcgtctcgacgccgtacaggcgtgcataggtcggatagaagctgtacgtgatgtcggggaagcgcagcggccggtcgtgcttgagcaacgcctggaatgcgtgcgcgagcacctcgtcggagccgttgccgacgaacacctgctcgggctggatgctgtgatgggccgcgaccgtctcgcgcagtgcgcgtgcaaccgggtccggatagcggcgcagcgtgtcgccggtcgcgccgagttcgcgcgcgatcgccgcgacgacgcgcggcgacggcggatagggattttcgttggtgttcagcttgaccgggtgtgcgagcgcgggctgctcgcccggcacgtaaggcacgagttgctgaacgacgtcgctccagtaacggctcaccgcttggctcctgtcgggcaaagcgaccagattaccgcaagtatgcgcaggatgggacgaacggggccgcccggcgacgccggacggcgcgatgatcgcggtggagcgctgcggtcagttgcgatgcagttgcatcgtcgcgcggtcgagttcgcccttgacgatcatcggcatcacggcgagcgcgcgttcgatcgacgcgtcgatcacgtcctgttcctcgcggcgcggcggcttcagcacgaagttcgcgacatcgggcttcgcgccggcgcgggcgctttccggaatcaggtcgcgcggatggccgatgccgatccgcagccgccagtactgttgcgacgacaggtgtgcggtgatgtccttcaggccgttgtggccgccgctgccgccgccgagcttcagcttcacggtgccgggcggcaggtcgagctcgtcgtgtgcgacgaggatctggtcgggcaggatcttgaagaactgcgcgagcgcgacgaccgactggccggagcggttcatgtaggtttgcggctcgagcaggtggacttcctcaccgtgcaggcgcgctttcgcgtagaagccatggaagcggcgttcgtcgcgcagcgtcgcgcctgcttcgcgggcgagctggtcgatcagccagaagccggcgttgtggcgcgtcgcagtgtattccgccccgggattgccgaggccgacgatcaatttgatcatgacgtttcgaaggcggcagccgccgcctgggcgcagaaaagaaaaacccgccgggcaagccgcggcgggttgcgtcgaccgttccgtgaaacggatcgatgagaggcgcgtaggcggccgcttaggcagccggcgtttcgccttcggctgcgtccgacacggcaccagccgggaccgtcgccgatgcgacaaccgggttttccgcgtcgacgtgcgcgaccagcgcgacgcccttcggcagtgcgatgtccttcgcgtgcagcgattgaccggcttcgatcttcgacaggtcgacttcgaggaactccggcaggtcagccggcaggcactcgatttcgatttccgtcgcgacgtgcgaaacgaccgcgctcgacagcttcacggccgggctgatttcagcgttcaggaagtgcagcggagccttcgtgtgcagcttcttcttcgcgtcaacgcgctggaagtccacgtgcagcaccagttgcttgaacgggtggtattgcacgtcgcgcagcagaacctgttgcgactggccagccacttcgaggtcgaggatcgacgagtggaaagcttccttcttcagggcgtgccacagggcgttgtgatcgagttcgatcttttgcggggctgcttcgccaccgtaaacgatacccgtggtcttaccggcgttgcgcaggcggcggctcgcacccgtaccttgctgttggcgctcgaaagcgacgactttcatatgattctccaatggctgcccgcgaccaggcagtaaaacggggccgtcaaatgtcggccccgatgaagcggacggggtttcgtctatcccgtccgattgtgcaaaaagcgaagcgttgccgcttcgctttctgcgcatactttgttcagtcgattcgcgatcaggattccgcgaacagcgacatcaccgaatcgccgcggcggatccgcgagaacgtttcggccagcaggctcgcgctcgtcagtgcacggatcttcgagcagccgagcgattcggcggacagcgggatcgtgtcggtgaccaccagctcgtcgagtgccgacgcggcgatgcgatcacccgcgccacccgacagcaccgggtgcgtcgcgtaggcgaaaacctgtttcgcgccgcgctccttcagcacttgcgcggccttgcagagcgtgcctgccgtatcgaccatgtcgtccatgatcacgcaggtgcggccttcgacttcaccgatgatgttcatcacttcggagacgttcgccttcgggcgacgcttgtcgatgatcgcgagatcgcagttgagttgcttcgcgagtgcccgggcacgcaccacgccgccgacgtccggcgacacgacgagcagatccgggtagttctgcttgcgcaggtcacccagcaggatcggcgttgcgtagatgttgtcgaccgggatgtcgaagaagccttgaatctggtcggcgtgcagatccatcgtgatgatccgctcgacgccggcgatttccagcatgttcgcgacgaccttcgccgagatcgcaacacgcgccgaacgcgggcggcgatcctgacgggcgtagccgaagtaggggatggctgcagtgatccggccggcggatgcgcgcttgagcgcatcgaccatgatcatcagttccatcaggttgtcgttcgtcggtgcgcacgtggattgcaggacaaagacgtccttgccgcgcacgttttcctggatctcgacctggatctcgccgtcggagaaacggctgaccattgctttgccgaggggataccaaggatattgacgacttcctgggcgagcgcgggattcgcgttgccagtaaagaccatcaggccatcatggctgtggctgctcatcgtgcacctgcttcaggcttgggcgggaaatgcgggaaaatttttggcaggggaggaaggactcgaaccctcgcatgccggaatcaaaatccggtgccttgaccaacttggcgactccctacacttaactgactgctttaccgaactcgtgtaggccgttcggcaaagtaaaacttcatgacgcgaaagcgaagagcggatgctcgtccagactctcggcaactgcaccattccaactggcgggcagcttggctttcgccgcttctgcctcgtgcttgctgtgaaacgctgcaaacacgcttgctccggagccggtcatcctcgcgggggtcaaatcatacaaccatttaaccgcctgcgcaacttccgcgtacttccttgttacaacttcctgcatgtcgttccggccgaagctgtctggccatcccgcatcgctggtttgctgtgcaagaaagtcagcaattgtgacgggcttcgtatctcttgtcaacaactcatctgaaaatatttcagcggtcgggacatgaacgcttggcgtcacaaccaagaaccagcgagtcggcaattgtacctcagctaattcttctccgataccctctgcgaacgcatttttccaaaaataaaaacgggacgtctgcgccgagtttgaccgcgagcgactgaagctcggcgcgaggcaggtcgagtcgccacaggcggttcagtgcgagcagcgtcgttgcagcgtcggagctgccgccgccaaggccggcccccatcggcaggcacttgtcgatctcgatgtcgacgccgtgcgcggtgcccgtatgtgctttcagcaggttggctgcgcgcacgacgaggtcactttcctcgggcacgccgggcacgtcggtgacgcgcgcgacgcgaccgtcgtcgcgcagcgtgaaatgcagcgtgtcgccccagttcagcaactggaacacgctctgcagatcgtgatagccgttcgggcggcggccggtgatgtgcaggaacaggttgagtttcgcgggcgcaaggcaattgcgcagcgagcgggtcgaatcggtcatgcgtatgtctgggctgggccggtgctcactggtcgagcacgagcttgatgtcgagcggcggggtcgcgcgcacgaggttgacgcgtttgacgcccgtggccggggcatccgcgtaggcaaggtagtcgatcgtccagccgtcctggcggatctgcttgacgcgcgtgccgtcggccgggtcgcgcaccgtttccgcaggggtcgcgggcgcggccgtgggcagcagccagtagcgcaggcccgcgagcggcagttcgaagccgagcgttttctgcatcaggtcgccgacgtccggcgcatattgcgtcggacggttcggcaattcgagcgatgccgcctgcggcgtcgatttcacgaccgcgagcgtctggccgagcgggctgcgcagctcgagcgacacgtcgtcaccgtgctcctgccagtcgaagttgccgtacacgttctgctgcttgccgagacggtcgtcgtactgcaccgcgaagcggccatggtaagcgtgcgctgcggcggtctgcagcggcgcgcccgttggcacgccggccgacggcggcgtgctcgcgcagccggcgagcgcgagcgccgcgccggctgcggccagcgtgcgctgcgcgcgggaggacaggaaaacgtcgggaacatctgcatcagaggccgttgatctggaggcgtttcagtgtctgcacgagcgtgtcgttgtccggctcgagcttctgcgcgtcacgccacgcggaacgcgcgtcgtcctgcgcgccgctcttccacagcacttcgccgagatgcgcgccgatttcggcgttcggttgcagttcgtacgcgcgccgcagcaccttcgccgcaccggccgtatcgcccatccggtacttcacccagccgagactgtccatgatgtaggcgtcgttcggcgcgagcgtcatcgccttgtcgatcagcttgctggcttcgggcagccgctggttgcggtcggcgagcgaatagccgagcgcgttgtacgcctgcggattgtcgggctgcgtgcggatcagctcgcgcagctgcttttccatcgtcgtgtagtggccggtttttcggccgccatcgcgtagtcgtagcgcaggtcgggatcgtccgggaagtcctggaccgcctgcccgagccgggcctcggcttccgggtagcgcttcgcggtgaacaggatcgacgcgtcggtgcgagcgaccacggcggcatcacgcggatccgtgatcggcaggtcgtcgagcaccttgcgcgcctcgtcggtcttgccctgtttctgcaacagttgcgcgcgcgtgatctgcgcggggagatagtgctggctcgtctggtcgaccttgtcgagccattgcgacgccagcgcgtcgttgttctggtcgatcgcgatctgcgcgaggtagatgtagccctggccgacgtcgaggttcggctgcttgtcgccgagctgtacgtactgcttcaggtaggcggtggcttcgtcgagcttcttctgctggatcttgatcagcgcgagcgccatcagcggcgtcggatccttcgagtcgagcttgcgcatcgtctcgaactgcttctgcgcgtcgtcgaggcgatcgtcggcgagatagagctgcgacagcgcgagccgcgcatcgcgcgacttcggattctgctgaacatacttctcgaacgacgcgatgcccgccgcgcgttccgcaggccccatctgcgacagcatcagggccgccggcaggtagtcggggcggatctgcagcgcctgcttcagcgactgcgcggcgccgtccttgtcgtcgaccgcaagctgctggcgcgcgatcgcgagctgagcctcgggccggttcaggtcgttcttcagcatgtccttcagcaccgcgaggccgccgacgcggtcggggccgcgcacgagcagcgcctgcagcgcgaggatcgccgggccgcgcgtctcgccggtcgcccgggccagctcgcgcgcgagcatcggctgcgcgtcggccggcttgccggcgagcaccagcagcgcggcgtcgacttgcgacgcccggttcgattccggtgcgtactggcgccacaggttcgcggcggacagcgcgtcggccgggctctgcgcaccgagcgcgatctcggtcgcgcgctgagccatgcgcggatcgcgcgtgtcgcgggcaagcgcgaggtaggtctggtaggccggcgcgggctggttgcgctggagcgcgacctcggcggcgagcacctggtagacgatctggctcgtcagcggaacgccggggagattcttctgctcgtccggcatcacgtgctcgaacgcgccctgcggttccgcgtcgtccgatgccggatcctgcgcgtgagccgggaaggcggtgagggtccaggcggcgaacagcgcggcgccgagcgcacggcggaccgggaaggcacgcgcgccgcgcacggcggcggggcgcttcagaagcagcttcgagggcagggtcatggaaatccgttcgatgtttcaaccgattgtaacgcgctcgctacaatacacgcacgatcgtgaatccagcctcagacccgtaaaacatgccagagttgccagaagtcgaagtcacgcgccggggcatcgagccctttgtcgcaggccgccgcgtcgagcgagtcgacgtccgtaccgagatgttgcgctggcccgtgccggcagggctcgccgagcagttgcgcgcgcgcgaggtgctcgccgtcgagcgtcgcggcaagtacctgctgttcgaggtcgacgcaggctggttcatcgtccatctcggcatgacgggcacgctgcgcgtgctgcccgccgacggcgtgccggtcgccgccaagcatgaccacatcgactggatcttcgacgaattcgtgctgcggttccgcgatccgcgccgcttcggcgcggtgctgtggcacccgcgcgaagcaggcgacgtgcatgcacatccgctgctcgcgagcctcggcgtcgagccgttctcgccggcgtttaccggcgcgctgctgcacgcgcgcacgcgcggccgcaccgtttcggtcaagcaggcgctgctcgcgggcgacatggtcgtcggcgtcggcaacatctatgcgtcggagagcctgtttcgcgcgggcatccggccgacgacggccgccggcaaggtctcgctgccgcgctacgagcggctggccgacgcggtgcgcgcgacgctcgccgacgcgatcgagcgtggcggcagcacgttgcgcgattttgtcggcagcaacggcgaaagcggctatttccagctcgactgcttcgtctacgaccgtgccggccaaccctgccgcgtatgcggcacaccgattcgccagatcgtgcagggccaacggtcgacttatttttgcccgacctgccagcgttgaaacctcagcgttgaaaccttattccccgatcagacaacttgaagccgccccgcatcgcccccgctccgttccccgtcacgccgctgcatcgcacgttcgccacgcgcctggtcgcatggcagcgcgagcatggccgccacgacctgccgtggcagaacacgcgagatccgtaccggatctggctgtcggaaatcatgctgcagcagacgcaggtatcgaccgtcatcccgtattacacgcgctttctcgaacgctacccggacgtcgccgcgctcgcggccgcgccgaccgacgatgtgatggcgctgtgggcggggctcggttactactcgcgcgcgcgcaatctgcaccgctgcgcgcaggtcgtcgtcgccgagcacggcggcgcgtttccgtcgacgcccgacgcgttggccgaactgccgggcatcggccgttcgacggccgcggcgatcgcgtcgttcgcgtacggcgcgcgcgcgacgatcctcgatggcaacgtgaagcgcgtgcttgcgcgggttttcggcgtcgagggctttccgggcgagaagcgtgtcgagaacgacatgtgggcgctcgccgaatcgctgttgcccgacgccgcgaatgcggccgacgtgagcgcgtacacgcaggggctgatggatctcggcgcgacgctgtgcgtgcgcggcaagcccgattgcgcgcgttgcccgttcgcgggcgattgcgttgcgcaatcgacgggccgccagcgcgagctgccggccgcgaggccgaagaaggcggtgccgacccgcaagacctggatgctcgtgctgcgcgacggtgatgccgtgctgctcgagcgccggccgccgaccggcatctggggcgggctgtggagcctgccgcaagcggacggcgacgccgcgctcgcggaactcgcgcgcggcttcggcggcggcggcacggtgccgctcgcgccgctcacgcacacgtttacgcatttccggctcgagatcgagcctcggctgagcgacatggccgacggtggcggcctgccttcgggggcgcgggatgcggataccgcgtgggtcccgctgagcaggctcgacgcgtacggcgtgccggcgcccgtgcgcaagctgctcgatgcgctgagcgggccgctgttgtaacgaacgggaagggcgcggcgcgggccgcgttcgggaacgcgccgggataccgcttgcgggaaaggtcttccggcgggtgcgacgcgcgacggaatcggccgcggtagttacagccagccgtgccggtcgagcacgtggtgcacggcatcgatgcgcgcgccgacgtccggaaactccatcagcttctgccgcgcgcgcaggtcgagcggcagcagttccgcgaggcggttcgacacccagctcggatcgtcgaggcggaacggttcgccgaacggcattttctccggatcggacttcttcagcgcgttgatgatgcgctcgagcacctcggcgcacgagccgaattgagcgagcgcctgctcgccttcgagcgggatgtcgtcgggcagcggctcagcgatgccgaccagcagcccgttgccttcgacgcgatacgacagcagctcgaaacgctgcgtgccgacggcctgcagataaagcatgccgaattcgccggtatcgcactcggtgatgcgcgccatgcagccgatggtctcgggtaccgacacggcgccgtcctgcgcgacttcgggcccgctcttcagcaggcacacgccgaacggcgcgttgtcgcgcaggcacgcgcgggacatgtcgagatagcgcgcctcgaacaccttgagcgggagcagccccggaaacagcaccgtgtgcagcggaaacagcggcaggtcgatcagggtggtcgatagggaggacatggcgcgcgggcgttggggcgtgcgtcgctagggtcggtcgacctcggagacgagccgcgacgacgcgtcgacatccactggcgcgtcacgatgccgcacgatcacgttcgcctcgcgcgcaaggcgcgcggcaagcgtttccgcgatgaacaccgaacgatgctgcccgcccgtgcagccgatggcgacggtcaggtagctgcggttgtcatcgcggaagtgtggcagccatttcatcaggaacgcatggatgtcgtcgatcatctggtggacgatcggcagtgcgtcgagaaaggcgatgaccggttggtcgagcccggtgagcgggcgcaactcgtggtcgtagtacgggttcggcagcgcgcgtcgaacatcaggtcggcgtcgagcggcacgccgcgcttgaaaccgaatgattcgaacatcaccatcaggtcgttgttcttctgctcgatgaagcgcttgacccacgtacgcagcgcgttcgcgcgcagcgtgctcgtgtcgatctggtggccgaattcggcgagcggcgcgacgaggtggcgttcgcgctcgatcgcttcctcgagcgacgacagcaggccgacgtccgcatcgtgcgacagcgagccggacagcggatgacggcggcgcgtttcggagaagcgctggatcagcgactgggtgctcgcgttgaggaacagcacgcggacgtcatgctcgcgcgacagctcgcgaatcaggccgggcatttcgtcgagcgatgcgctcgagcgcgcgtcgatcgcgaccgcgagccggtgctggccatcctccgcgaggtagcgggcaagttcggggagcacgtgcggcggcaggttgtcgacgcagtaatagcctgcgtcttcgagcgcgttcagcgcgacggacttgcctgagccggagatgccggtgatgaggacgatgcgcatgggaagcagagaatcctgacgtttcatcatagcaccggctcgacgcgtcggcgttgcgtggccggcgcgtgcgggttacaccagtttgccggggaattgactgtcgggatcttgcatcgcgagtcgttgccgatccatgaaatcgcgcaacgtgtcgattccgcgcaactgcaggatcgtgttccggacggccgcctcgacgagcaccgcgaggttgcggccggctgcaacctggatcgtgaccttgctgatcggcaagccgagcacgtcgacggtctggctttcgagcggcaggcgctggaattcgccgtcggggcgccgcacgagctggacgatcagcttcagcttcattttccgccgcacggcggtttcaccgaagatcgtcttgatgtcgagcaggccgaggccgcgcacttcgagcaggttctgcagcagcggcgggcagcgcccttcgacgaaatcggggccaagtcggacgaaatcgaccgcgtcgtcggcgacgaggccgtggccgcggctgatcagctcgaggccgagttcgctcttgccgaggcccgaatcgccggtcagcagcacgcccatcccgaggatgtcgatgaacacgccgtgcagcgtcgcgcgcggcgcgaggatccgtgacatgtagagccgcaggctgtcgatcaccgcggcggccgacatcggcgtcgtgaacagcggggtcgacgagcgcgtacagcgcagcacgagttcgggcgggcggcggcgccgcccgcgacgacgaggaacggcggttcgagagcgatcagctcggccatgtggcgcgagcggtcttcgtcggtctgccgctggtagtagtcgatttcggcttcgccgagcacctggatccggttcgggtggatcaggttcaggtggccgacgaggtcggcgctcgaggttgcattgccgacggtgtcggccgaaaagccgcgttcccagccttcatgccccgtcagccagctcagtttcagcgtggccgcgttgtcgtcgaagatgctctgggcgttgatgctggacgtatccatgactgctccgtcactccaatgggccggtgcatgcgcgcggcgacggacgtcgccatgccgggccggcgccgggcggccctggacggcggcgtgtgccgcctcgtacgggaaaataatccgcccggatcaactcaaggttgccactgagtgagcaggcgatgcaactcggcgatgtccgtttcgttgtgcagacgctcgcgcgcgtcgcgatcggacagcagttgcgcgatttccgacaggatttcgaggtgttgctgggtggcttgctcgggcacgagcaggaagatcaggaggccgaccggctggccgtccggggcttcgaacgggatcgcatcggcgagccgaacgaacgcggcgagcgggtgcttgagacccttgatgcgcccgtgcggaatcgcgacgccttcgccgagcccggtcgagccgaggcgctcgcgcgcgaacaggttgtccgtgacggtgctgcgggcgatgccgttctgattctcgaacatcagcccggcttgttcgaacacgcgtttcttgctggtgactgagaggtcgatgacgacgttctctatgggcaggattttggctaggcgattcatgttggcaggcgattgggcggcctggggtctccttgcggcggcagactgatcatccatgttcggcgatatcaaggcgttctgcatcggcaatctgcaaggcagctaccgcatccagcgcccccggcgataaccggaacattatagagcacagctgcgtgcgtggcgcagcgtggacggaccggttgcaccgccgcgaggagtcgcaaaaacgcccggcgagccgggcgacgtgtgtgttgcggtgaaggttactgcggcggcagttcgatctggtcgatcgacggttgaagcttgatcgggtcgtgcgcgtgcgtttgcaggcgctccatgtgcttgacgacctgacggtccagcttgtcgatcagcaggtcgatcgccgcatacaggttaccgttcgcgctttcgacgaagatgtccttgcccttcaggtgcagattgatttccgcgcgctgctgcttgtccttttccttgtgattgtcgaccgagaggatcacagtgccatcgatcacctgatcgctatgccgtagcacccggtccagcttggtgatcacgtattcgcgaattgcaggcgtgacttcgagatgatgtccactgatcttcaggttcatagtgcttctccaagcgagtgaccacccggccgcatcgaggcggcgctccggtcgacttgcccgtgccgcacgaggcggcgtatcgcggacaggtcgcccggcctgttccccgtgtgcgcggtggccggaacacgcctgccgccgggcaggcagcaggcttaaagagacttgcgcagattcactgccgggatcttgagggcttcgcgatacttcgcaaccgtgcggcgcgcgaccacgaacccctgttctgccagcagctcggcaatgcggctgtccgaaagtggcgattttgggtcttcagctcctatcagttgcttgatgagggctcggatggcggtcgacgaggcggcgccaccggtgtcggtcgagacgtgagatccgaagaagtacttaaattcaagcgtcccgaacggggtcagcatgtacttcccggttgtcacacggctgacagtcgactcgtgtaggcccagcgtatcagctatttcccgcaaaaccaaggggcgcatggcaatttcaccgtgcgcaaagaagttcttttgacgctcgacaatcgcctgcgcgacacgcaggatcgtgtcgaatcgctgctggatgttcttgatcagccagcgtgcttcctggagctgctgcttgagcgaaccggccgacggatcgccgcggctgttgcgcaggatgttcgcgtagaggttgttgatccgcaggcgcggcacgacctccggattgagctccgcgagccatccctggccggccttcttcacgatgatgtcgggcacgacgtagtcggcctcggccttgccgtatgcggcgccggggaacggctccagcgagcggatcagcgtgtgcgcgtcgcgcagcgcgtcgtcgctcgccttcaggtgcttgcgcagccgcgtgaagtcgcgggcggcgagcagttcgagatgctgcgacacgatctcgagtgcgagcgtgcgtgtcggggacggatcgaggcgcagcaactgcagcttcaggcattcggatgccgagcgggcgccgaccccggccgggtcgaagctgtgcagcagcgcgagcgccgcattcagttcgtcgcagtcgatttccagctcgggcggcaggtcggcgagcacttcgtcgagcgtggcggtcaggtagccgtcgtcgtcgagcgattcgatcaggaacatcacgagcgcgcgatcgcgcgggctggcctgcgtgacgcgcaactgcgcggacaggtggtcgcgcagcgacgtcgccgcttcctgcacctgcagcggcgggaggtcgtcgtcgtcggatgcgccgctcgcgcggccgaattcgtcgagattccactgcgggccgtcgttgccgtcgccggacgcgtaaccgtcgtattcgtccgcgccggccggttcgtcgcgctcggcgcgctcgctcgacgaactgctgctgtttgtcgcagcgggctcggtgttctgggcgggaggcgtctgcgcgatcaacgatccgtccgctgcgacacgcagcgggctcgctatccattcgtcgtcgttctcgagcagcgggttctgcgcgacggccatcgcgacttcctgctgcaattcgagcgtcgacaactgcaggagccggatcgactgctgtagctggggcgtcagcgccagatgttgcgacaggcggagttgaaggctggctttcatggcaaggaggagtcataccggcagtttgccacgacccaggcgcgttgagccatccgcgattacgcgcggcgcgccgcccggccgcgggcacggccgcgggcgtggttgcaaagcaggacgcggccccgcgcggcgatgccgggcggggtgcagccagccacgaaggggagttacatccggaagtgttcgccgaggtacacgcggcgcacgctttcgttttcgatgatttcgctcggcgcaccggcggcgagcaccgaaccgtcgctgatgatgtatgcgtggtcgcagatgccgagcgtttcgcggacgttgtgatcggtaatcagcacgccgatgttgcgctgcttcaggaacttgacgatcttctggatctcgagcaccgcgatcgggtcgacgccggcgaacggttcgtcgagcaggatgaagttcgggttggtcgcgagcgcgcgcgcgatttcgacccggcgccgctcgccgcccgacagcgacagcgcggggttctcgcgcaggtggccgatctgcagctcgtcgagcagcgcttcggtgcgcgacgcgatcgcgtccttcgacagccgcttgccgtcttcgccgtgctgcaactcgagcaccgcgcggatgttttcctcgacggtcagcttgcggaacaccgacgcttcctgcggcaggtacgacaggccgagcgatgcgcgcttgtggatcggcagcaggctgatcgagctgccgttcagcgagatctcgcccgcgtcgagcggcacgaggccgacgatcatgtagaacgacgtggtcttgccggcaccgttcgggccgagcaggccgacgacttcgccgctcttcacgtcgagcgacacgtccttgacgaccgtgcgcgagccgtagcgcttcttcaggttgcggaccacgagcgagctcgtggtgccggccggctggcggttcggtagtgcgttcattggcccggcgcccctggatcgtggtcgacggcgacagcttcgccggcgcgccgttcagcggcgcggggccgccgttcttcggcgacagcatcgcgcgcacgcggccgttcgggttgcccggtgcggcgacgtccttgccgcccttcgcggtgtagaagtcgcgctggccgtcgtacgtgatcacgctgccgtgcacggtatcggcgacggtcgacgtgccctgcaggcggcgcacggtcgcggcggtggtcagcgtggtcaggtcctgcttgccgtcgtagtcgatgcgctcggcgtcgccgtcgatgtactcgtcgaggccttcgcgcttctggcggaacgtcgcgtgcttcttgccgctgccgaacgaggtggcgtactgatagccctccgggtcctggcgcacttcgacgcgatcgcccttgatgatgatcgtgcccttcgtgatcacgacgttgccggtcgcgaccgtgacctgcttcaggtcgtcataggtcaggttgtcggcctcgacgttgatcggcttgttctggtcggccttctcggcatgggcgagcggcgccagcccggccagcgggagcgccacgagcgccgcggcaagcgcggcgcggacggcgcgcgcagcgccgccggaattctgtcgagggaacggttcgttcatgcagtcacgtgagggatgcgtcacttgggttgacctttcgagccgccggacgtgtccgccgcggcgatcgtgccgcgcacgttgccgtaaagctcgatgacccgggtgacgttgttgtacttcatgccgtcggtcgcgttgacgagcgacaggccgcgctgaagtttaaccggcttttcggtctggatcacatcgtcattgacgaagatccggaaatgctgggaatcggcctgcatctgcggatcgccgccgccggccgcgcgcaggatgcgcgcgtcgtcgtacaagtcgacgatcgacacgtcgccgttgacgatgccgcgcttcgcggtggtcgtcacgaccggcttgccgggctggaacgcgcgcatggccggatcggtcaggtcgctgttttcggtgtcttcgtagtggatcagcttcgcggccgtcagccggtactgggtcgtgccggactggtcgagctcggtgaccgagaaattgtccgcgaaatagtcgggcgtatggcgcttcggctgcgcggtgccctcgccgggcggcggcagcgtggcctgcagcagccaccaggtgatgcccgcgagcgcggcgaccgcgacgagcggcagcagctgggtccagcggaaatgcgtgttcatccgtcaggctccgcaggcggccgcgagcagcgcgtcgtagcggcgctgcgcgcgcaggatcgcgtcgcagacttcgcgtacggcgccgtggccgccgcgggcctcggccacccagtgcgcgcgggcgatcacctcggggtgcgcattcgcgggggcggtcgcgaagccgcagcgcagcatcacgggcaggtcgggccagtcgtcgcccatgtagccgcattggtcggcggcgaggccgagcgatgcgatgagatcggcgaacacggcaagcttgttctcgacgccctggaacaggtgcgcgatcttcatttccttcgcgcgtgccgcgacgatttcgagcggcggcccgtgatgatcgcggttgcgatgccggcttcgccgagcagcttcacgccgtggccgtcgagggaattgaacgacttcatcgtgtcgccggccgccgtaaacagcaggccgccgtcggtcagcacgccgtcgacgtcgaaaatcatcagcttcacgcggctcgcgcgttcggccgcagtcagcgctgcgctcatcagatcaccttcttcgaaaacaggtcgtgcatgttcagcgcgccgatcagcacgccgtcggcatcgaccaccagcatctggttgatccggtggcgctccatcagttccacggcctcgaccgccaggtgatccggtgcgatcgtgcgcgggtcgcgcgtcatcacgtcggtgatcgacaacgtgcggaagtcgccgtcgcgcgcgagcacgcggcgcaggtcgccgtcggtgaagatgccggcgaccttgccgtcggcatcgaccacggcggtcatgccgaggcgcttcgcggtgatctggaacagcgcgtccgacagcgtcgcgtcgagcccgacggacgggacgtcgtcacccgagcgcatcacgtcgcgcacgtaggtgagcaggcgccggccgagcgcgccgcccgggtgcgagcgcgcgaaatcttccgaaccgaagccgcgcgcgtcgagcaccgcaacggcgagcgcgtcgccgagcgcgagcgcggcggtcgtgctcgcggtgggcgcgaggttcagcgggcaggcctctttcgagaccgcggcgttcaggttcacgtcggcgagcgtgccgaggctcgatcccgcgcggcccgtgatcgcgatcagtttcgcgccgatccgcttcacgagcggcaggatcgcgacgagttcttccgattcgccggaataggagatgccgatgaagacgtcgtcggaggtgaccatccgaggtcgccgtggctggcctcggcggggtggacgaagaaggccggcgtgccggtgctggccagcgtggccgcgatcttgcgggcgatatgccccgatttgccgataccggacaccaccacgcggccgcggcagccgagcagcagcgcgacggcctggacgaagccgccgtcgagctggtcgcgcagcgcgcgcacggcgtccgcctcgatgtcgagcacgtcgcgggcgagcgcgagcgcccgatcatcattgattttcgctatcatgcgcggagtatagcaaaggcgtttgttcgccgcgccgggccttcggactcgtccgatgtcgcctgtccaccgccaccctgccgcgcccgctttcccgtggccccgacgaacgaggacgctttgcccgtgatttcccgctcgaaatgacgctcctgctgctgctggcatcggtggtgggcgtcgtcgtattccgctcgctgaacctgccgccgatgctcggctacctgaccgtcggcatcctggtcggcccgcacgccttcggcatcgcggccgacctcgagcgcgcggagcatctcgcggaattcggcgtggtgttcctgatgttttcgatcggcctcgagttctcgctggcgaagctgagggcgatgcagcggctcgtgttcgggctcgggctgctgcaggtcgtcgcgacactcgtgctcgcgctcgtgctcggcatgctgttcgagcactgggtacacatcacgtggcagggcagcatcgcgctcggcggcgcgctcgcgatgtcgtcgacggcgatcgtgtcgaaaatgctcgccgagcggctcgagatcgagaccgaacacggccgcaacatcttcggcgtgctgctgttccaggatctcgcggtggtgccgctgctgatcgtgatcgccgcgttcggcgccgaatcgtcgaaggacctcgcgctcacgctcggtttcgcggccgtcaagatcgtgatcgcgctcacgctgctgctggtcatcggccagcgtttcatgacgcgctggctcaacgtcgtcgcgcggcgccgctcgcaggagctgttcgtgctgaacctgctgctcgtcacgctcggcgccgcgttcatcaccgaccgcttcggcctgtcgctcgcgctcggcgcgttcatcgcggggatgctcatttccgagacgccgttccgccatcaggtggaagaggacatcaagccgttccgcgacgtgctgctcggcctgttcttcgtgacgacggggatgctgctcgatccgcgcgtgatctgggagcacccgttcctcgtgctcggtttcttcgtcgggcaaatcctgttcaaggggacgatgatcgccgggctcgcacggctgttcggcgcgacgccgggtgtcgcgatgcgcaccggcatcgggctcgcgcaggccgggaattcggcttcgtgctgctgaacctgatcctcgaccggcatctcgtcgattcgacgctgctgcaggcgatcctcgcgtcgatgctgctgtcgatgctcgccgcgccgttcctgatccagaacgccgaccggatcgtgatgcggctttcgtctacggaatggatgcagcagtcgctgcagatgacgcggatcgcgacgcaaagcctcaagcagcgcggccacgtgatcatctgcggctatggccgcgcgggccagaacctggcgcggatgctcgaacaggaaggcatttcgtacgtcgcgctcgacctcgaccctgatcgcgtgagcgcggccgcgacggccggcgaatcggtcgtgttcggcgacgcggcgcgccgcgagtcgttgctcgcggccggtatccatcgcgcggcggcggtggcgatcacctatgcgaacacgccgtccgcgctgcgcgtgcttcaccacgtacacgaactcgagccgacgctgcccgcgatcgtgcgcaccgtcgacgatgccgatctcgagaagctgctcgcggccggtgcgaccgaggtgattccggagatcgtcgagggcagcctgatgctcgcgtcgcacacgctggtgctggtgggcgtgccgatgcgcaaggtcgtgcggcgcgtcgaggaaatgcgcgacgagcgctacagcctgctgcgcggctatttccgcggcgcggacgatgcggacgacgacgaccacgagcaggtgcggctacaatcggtgccggtcgatgcgcgcgcggacgcggtcgggcgttcgctggaagaactcgggctgtatgcactcgggctcgaagtcacggcgatccgccggcacggcatccgcggcgtcgaacccgatccgcagaccaagctgcgcgcgagcgacatcgtcgtgctgcgcgggctgcccgaggcactcgcgctcgcggaggagcggctgtcgcgccatcggcgcgatccgccagccgcggcagcctgagccgcgcacggattgataacctgacccgtatttattcgaaacggtgcccgatcttcgcgcaccgtttttcggagagtttcatgccgcattcgtcgtcgggcgcaccgctcgatccggtcgccttcatccacagccagatccgcacggtgcccgactggccgcagccgggcgtgatgttccgcgacattacgacgctgctgcagagcccgaaggcgttgcgcatcctcgtcgacctgttcgtcgagcgttatgtcgatgcgaagctcgactacgtcgcgggcctcgacgcgcgcggcttcatcatcgcgccgatcgtcgcgtacgagctgagcgtcggcttcgtgccgatccgcaaggtcggcaagctgccgtacaagacgcgctcggaatcgtacgacctcgaatacggcagcgcgacggtcgagatccatgaagacgcgtgccgccccggcgaccgcgtgatcatcatggacgacctgatcgcgaccggcggcacgatgatggcggggcgcaacctgctgcagcggctcggcgcggaggtcgtcgaaggcgcggcgatcatcgacctgcccgatctcggcggctcggcgctgctgcgcaacgcgggattgccggtttataccgtcaccgaattcgccggccactgagcgccggcacgcctgattccacgtcacacacagcgaggtctcgatgcccaacttcatgctgtttctcgccacgtcgatcgcgattacgttcgcgccgggtcccgacaacctgcaggtgctcgcacgcggcatctcgcagggccgcgcggccggtttcgtcgccgcgctcggcttcaccgccgggatcctgttccacacgacgctcgcggcgctcggcgtcgcggccgtgctgcgttcgtcgccggtcgcgttcgagatcctgaagctcgcgggcgccgcgtatctcgtgtggatcggcatcaaggcgctgcgcagccagggcctcgcgaacgcgcacgagcgcccgccgcagccgctcggcacgatcttccggcagagcgtgatcggcaacctgatgaacccgaaggtcacgctgttcttcgtcgtgttcctgccgcagttcgtcgatccgcacggcgggcagggcgtgacgctgcagatgttcgaactcggcgcgctgttcatgctgcagacggccgtggttttctcgctgttcggcgtcggcgcgggcatgatcggcgcgtggctgaagcgccgcccgaaggccggcgtgtggctcgaccggatcgccggcgcgacgttcatcgcgatcggcatccgcgtggcgctgaaggactgacgacgatgacgtttccgtgcattgcggccgcgcgccgtttcgatccggccgcgcacctgcgtttcgagatggccggccaggcggtcggctgggtgcgccgccaggatgtcgcgatgctcgcccgctggcccgacgtgttcgagctgaccgacgagcgcgtcgtgctgtcgtcgcgctacgactcggtcgacgcacgcagcatggcgctggcgagcgccatcggcgcgctcgcggccgacggcgcgattcccggctggcgcgacgagatctacgcgatccgcaaccgcttcgacgatccgccgctcgcgtacatcgagcgcgccgcgtcgcgcttcttcggcacgcagacttacgcggtgcatctgaacggcatcgtagaatatgcggttgcgccgggcgagccgcccgccgcggccgtcccgcagatgtggctcggccgccgcagcgagaccaaggcaaccgaccccggcatgctcgacaacgtcgtcgcgggcgggatcggctggggcctgggcgttcacgagacgctcgcgaaggaatgctgggaagaagccggcattcccgccgaactggccgcgcgcgcgatcgcgggccgtgcggtgcaggtgctgtgctcgctgccagaaggcacgcagtccgaactgatcttcgtgtacgacctgccgctgccgcgcgacttcgcgccgcgcaaccaggacggcgaagtggccgagcacctgctggccggcgtgcccgaggtgatcggctggctgcgcgccggccgcgcgacgatggatgcgagcctcgcgacgctcgacacgctgctgcgccaccgctggatcccggcggccgacgcggcgggcatcgacgccctgttcgcaccggccgcgtgacgcgtgccgcgcacgcagtccggcggcgcgaacgggcaatttgacgaatacggaaacgaagggagtagcggtcatgccgaccgatcacagctttatcttgaaactgtcgtgcccggaccggcacggcatcgtccatgcggtctcgggcttcctgttcgagcgcagcaacaacatcctcgattcggcgcagttcggcgacagccgcaccagcgaattcttcatgcgcgtgcacttcgagcaggacggcggcggcgcggatgccgcggcggcgctcgacacgcttcgcaaggaattcgcgccgctcgccgagcagttctcgatgcgctgggagctgcatgacgcggccgtgaagccgcgcgtcgtgatcatggtgtcgaagatcggccactgcctgaacgacctgctgttccgctatcgcaccggccagctgccgatcgagatcccggcgatcgtgtcgaaccacaaggagttctaccagctcgccgcgagctacaacatcccgttccatcactttccgctgatcggcggctcgtccgatgccgcgaaggccgcgcaggaagcgcgcgtgctggaagtgatcgacgagcaccaggccgatctcgtcgtgctcgcgcgctacatgcagatcctgtcgccgaacatgtgcgaacagctcgccgggcgcgcgatcaacatccaccattcgttcctgccgagcttcaaggggcgaagccttattaccaggcgttcgatcgcggcgtgaagctgatcggcgcgaccgcgcactacgtgacgaccgatctcgacgaaggcccgatcatcgagcaggaagtcgagcgggtcgaccacagcatgacgcccgaccagctgaccgcgatcggccgcgacgtcgagtgcgtgacgcttgcgcgcgcggtgaagtggcacgtcgagcaccggatcgtgctgaacgggacgaagacggtcgtgttccgctgattcgccggcaccggcccgttacaagcaaaaacgccgcaccctttacagggtgcggcgtttttgttgcctgagcgcgcaggctgcttcagatcagccgcagcaggtacaactcgcgcttcaggtacgcgtagaagatcggcgcggcgatcacgccgggcagcccgaacgcggcttccatgatcagcatcgcgagcagcagctcccacgcgcgcgactcgatctggccgccgatgatcttcgcgttcaggaagtattcgagcttgtggatgaccacgaggaacgcaagcgacgcgatcgcggtgcccatgctgaccgacagcgacacggcgacgatcagcgtgttcgagatcaggttgccgatcacgggcagcaggccgacgatgaacgtgacgagcacgagcgttttcgacagcggcagccgctggtggaagatcggcagcgcgaccagcaggtagatgccggtgaacaccgcgttgatcgccgagatcttgatctgcgcgaacacgatccggcggaatgcgtcggcaaagcgcgacacgcgcgtgacgagcgcggtggacagcggccggcgcaccttgccgtgctcgacgccgatcgcgatcatcgcgccgatgatcatcccgaacagcacgtggccgaacccgcgcgcgacgctcttgccgctttgctgaagctggtccatgtgcgagtgcatcagcacggcggccttcgtcttcatctgctcgacgtcgacgggcagcaggttcgcgatccaggccggcgtgcgcgcgcgggtctgctcgacgatctgcatcagctggtcgagcaggctttgcaggttcggcaccgtgcgttcgaagtgctcgatgatgccgatcgtcaggcccgtcagcgcgccgacgatcgcgatggccagcagcacgacggcgacccagcgcgcgcatgctcgtggtgtgacgttcgatcacgggggcgatcgtgtggatcagctggtagacgagcaggccggccagcagcccgccgagcaacttgagctcgatcacgagccacatcgcgaggatcgcaaccgcatagctgccgatctcgagtgccgacagcttcggcaggctgaagtcgctcgtcagccgcacgctgcgcaggtgcggttcgcgattctgcgtatcgcgagacgagtctggttgcttctccatcgtggattcctgtcgttcgtgtgtcatgccgcggaatgcgcggcagagccgtgttcgcccggcgccgcaccggattggtgcgtacggcgaaccttacgaccgtaaagtatagccgccattatgggccgcaacggggccgtttggcgcatggtgtaaacgcagaagggaaaacgagaggaggccggttgcgcggtgcgcaggcgcgcgcggccgggcggccgcgcgcgggagggacagggcggcgcgaagcgtcagcccgccgcgaccttgcgggtcgggcgcttgagcagcggcgcgaggtacttgccggtaaagctcgctttcgtcttcgcgacctgctcgggcgtgccctgcgcgatgatctggccgccgccggcgccgccttcggggccgaggtcgatcacccagtcggccgtcttgatcacgtcgaggttgtgctcgatgatcacgactgtgttgccctggtcgcgcagccggtggatcacttccagcagcagcgcgatgtcgtggaagtgcaggccggtggtcggctcgtcgaggatgtacagcgtgcggccggtgtcgcgcttggagagttcgagcgacagcttcacgcgctgcgcctcgccgcccgacagcgtcgtggccgactggccgaggcggatgtagccgaggccgacgtcgagcagcgtcttcagcttgcgcgcaatgaccggcaccgcattgaagaacgcgtacgcgtgctcgacggtcatgtcgagcacttcgctgatgttcttgcccttgtactgcacttcgagcgtttcgcggttgtagcgcttgccgtggcacacgtcgcacggcacgtagacgtccggcaggaagtgcatctcgaccttcagcacgccgtcgccctggcacgactcgcagcggccgcccttcacgttgaacgagaagcggcccggatcgtagccgcgttccttcgaggtcggcacgcccgagaacagctcgcggatcggcgtgaacaggcccgtataggtggccgggttcgagcgcggcgtgcggccgatcggcgactggtcgacgttgatcaccttgtcgaagtgctcgaggccctcgatcgcctcgtgcggcgccggttcggccgacgagccgtacaggtggcgcgcgaccgcgtgatacagcgtgtcgttgatcagcgtcgacttgccggagcccgacacgccggtgatgcaggtcagcaggccgaccggcagctcgagatcgacgtgcttcaggttgttgccgtgcgcgtcgacgatgcgcagcatccgctcgggatcgggcgcgagccgctcgtccgggtactcgatcgtgcgtttgccgaccaggtactggccggtgagcgactgcggattcgactgcacctgcttcggcgtgccttcggccacgatcacgccgccgtgctcgccggcgcccgggcccatgtcgacgacgtagtcggccgtgcggatcatgtcctcgtcgtgctcgacgacgatcaccgagttgccgaggtcgcgcaggtgcttgagcgtcgcgatcaggcggtcgttgtcgcgctggtgcaggccgatcgacggctcgtcgagcacgtacatcacgcccgtcaggcccgagccgatctgcgacgcgagccggatgcgctgcgcctcgccgcccgacagggtctcggcgctgcgctcgagcgacaggtagtcgaggccgacgttgttcaggaacgtcaggcgcgcgacgatttccttgatcaccttgtcggcgatctcgcgtttcgcgccttcgagcgtcagcccgtcgaaatagccgagcgcgtcgcgcagcggccagccgctgatttcatagatgccgcgcgcgtggtcgccggtgccgatgcgcacgtggcgcgcctcgcggcgcaggcgcgtgccttcgcacgacgggcacggctggttgttctggtacttcgacagctcttcgcgcaccgcgaccgaatcggtctcgcggtagcggcgctcgaggttcgggatgatcccttcgaacacgtgctcgcggatcgtcgtgcggccgcgctcgttgatgtacgagaacgggatcgtctgcttgcccgagccgaacagcagcaccttccggatcttttccggcaggtcctcgaacgcggcgtcgatgtcgaattcgtagaaggccgcgagactctgcagcatctggaagtagaactggttgcggcggtcccagcccttcacggcaccggccgcgagcgacagcgacgggtgcgcgacgacccgcttcgggtcgaagaacgtgatctggccgaggccgtcgcattccgggcacgcgcccatcgggttgttgaacgagaacaggcgcggctcgagctcctgcagcgagtacgagcagatcgggcacgcgaacttcgagctgaacaggtgctcgtggtcggtatccatttccagcgcgatcgcgcggccgtcggcgaggcgcagcgccgtctcgaacgattcggcgaggcgctgcttcatgtccgggcgcaccttgagacgatcgacgacgacgtcgatcgtgtgcttgtcgttcttcttcagcttcggcagcgactcgacctcgtagatcttcgcgacgccttcgttcgcggcgccgccgcccgagcgcacgcgaaagcgcacgaaaccctgcgcctgcatgtcctcgaacagctccgcgtgttcgcccttgcggttcgcgatgacgggcgcgaggatcatcagcttggtgtcctcgggcagcgcgagcgccgcgtcgaccatctgcgacacgctctgcgcttccagcgggatgtcgtgatcggggcagtacggcgtaccgacacgtgcgtacaaaagtcgcaggtagtcgtggatttccgtgaccgtgccgacggtcgaacgcgggttgtgggacgtcgccttctgctcgatcgagatcgcgggcgacagaccctcgatcaggtcgacgtcgggtttctccatcagctgcaggaactggcgggcatacgcggacaggctttcgacgtagcggcgctggccctcggcataaagggtgtcgaacgcgagcgacgacttgcccgacccggacaacccggtaatcacgatcagcttgtggcgcggcaggtcgagattgacgtttttcaggttgtgggtacgtgccccacggatacggatctgttccatgaacctggcgaaaatggagggaaccaaacctgctactataacggcttttcgaggccgtcgtttggggccccggccttggccgcaggtggcagcaaggcggcgcctgcgccgggaaagcggccgcgccgcgcggttccgggtggcccgcgggctgcctgagtcctgccccgacgtgtcgcccgccaagcctcccgggccgctggtcctgatcttccgccgcccggtgtcgggcggtcatcccgatcattcgaaatacattcccgatgtccaatccgtctgccacgtcttcccgcatgactgcgcccgaattgcgcgcgaccacgtcgctcgcggcgatcttcgcgctgcgcatgctcggcctgttcatgatcatgccggtgttctcggtctacgcgaaaaccatcccgggcggcgacaacgtgctgctcgtcggcatcgcgctcggggcctacggcgtcacgcagtcgctgttctacatcttctacggctgggcgtcggacaagttcggccgcaagccggtgatcgccacgggcctcgtgatcttcgcgatcggcagcttcgtcgccgcgttcgcgcacgacatcacgtggatcatcgtcggccgcgtgatccagggatgggcgcggtttcgtccgcggtgctcgcgttcatcgccgatctgacctccgagcagaatcgcacgaaggcgatggcgatggtcggcggctcgatcggcgtgtcgttcgcggtcgcgatcgtcggtgcgccgatcgtattccactgggtcgggatgagcgggctgttcgcgatcgtcggcgtactgtcgatcctcgcgatcggcgtcgtgctgtggatcgtgcccgacgcggcgaagcccgtgcacgtgcccgcgccgttcgccgaggtgctgcacaacgtcgagctgctgcgcctgaacttcggcgtgctggtgctgcacgcgacgcagacggctctgttcctcgtcgtgccgcgcctgctcgtcgacggcggcctgccggtcgccgcgcactggaaggtctacctgccggtgatggggctcgcgttcgtgatgatggttccggcgatcatcgtcgcggaaaaacggggcaagatgaagccggtgctgctcggcggcattctggctatcctgatcggtcaattgctgctgggcagcgcgccgcataccatcctgattgtggcggcgattctgttcatctactttctcggtttcaacatcctggaagcgtcgcagccgtcgctcgtgtcgaagctcgcgcccggttcgcgcaagggtgcggccacgggtgtctacaacaccacgcagtcgatcgggctcgcgctcggcggcatcgtgggcggctggctgctgaagcacgggggcgccaacacggtgttctacacgtgctcgggactcgttgccgcgtggcttataatcgcggccagcatgaaagcgccgccgcgcaaggcctgaactcacttcgggcaggcaccggcggcgttcgccggcttgcccggcgggccgcaccggcagcgtgagcgggcggcccggcatcgaatttactggagaaacacatggcatccgtcaacaaggtcatcctcgtcggcaatctcggcgccgatcctgaagtccgttacctgccgagcggcgacgcggttgcgaacatccgtctcgcgacgaccgaccgctacaaggacaaggcaagcggcgatttcaaggaaatgaccgagtggcatcgcgtcgcgttcttcggccgtctggcggaaatcgtcagcgaatacctgaagaagggttcgtcggtctatatcgaaggccgcatccgcacgcgcaagtggcagggccaggacggccaggatcgttactcgaccgaaatcgtcgccgaccagatgcagatgctcggcggccgcggcggtgcgggcggcggcggtggcggcggtgacgaaggcggttacggcggcggctacggtggtggcggcggcggtggtcgcggcgaacagatggaacgcggcggtggcggcggcggtcgtgccggcggcgcagcgcgtggcggtggtggcggcggcgcgcaaagccgtccgagcgcaccggcaggtggcggcttcgacgaaatggacgacgatatcccgttctgatcggcacgccggtatcctgcgtcacgatgggcccgaatctccgagtcaagccgattgcttggcccgggtcttcgggccttctttcgtttacgtcgatctttcttgcgcgccaggcaaatcgtggctgacgaacttcccgacctcatcgcggagcatctcgacgtgctgttctgcgggatcaaccccggcctgaccgcggccgagaccgggcatcacttcgccgggaggagcaaccgcttctggcgcgtgatccatctcgcgggcttcacgccggcggaaatttcgccgcaggacgatcgcgcgatactcggccatggctgcggcctgacggcggtggtgaagcggccgaccgcaagtgccgatcagctttcgcgcgcggaattcatggctgcggccgcggggttcgagcaaaggtggcgcgttatcggccgcgcttcgttgcctttctcggcaaggcggcgtactcggcgctttccggccagcgtgaggtcgggtggggattgcagccggcccgcatgcagggggcaagtgtctgggtgctgcccaatcccagcgggagaaatctcgcgttcggcctcgacgatctggtcgatgcctaccgtcaactgcgtctgcacgcgaaggccggttccggtcttcaaccggagaggcgggatgcggcgcggtgaacccgcgcctgcgtggccgggcgccgtgctgccccgcgcgttcttcgaccgcgtggccaccgacgtcgcgccgcaactgctcaacaagatcctcgcggccgcggacggccgggcagggcggatcgtcgaagtggaagcctatgccggcgcgatcgacccggccgcgcatacctatcgcggcaggacgccgcgcaacgcgacgatgttcgggccgccggggcacctgtacgtctatttcacctacggcatgcactggtgctgcaactgcgtgtgcggcccggacggcacgggaacgggcgtgctgatccgtgcgctcgagccggtgcacgggatcgaacggatgcgcgcggcacggccgccgcagacgcgcgatcgtgatctgtgccgcgggccggcgcggctgacgcaggcgatgggcatcggcggtgcgcaggatggcgtcgatctcgtcgctgcgcgcgaagggttcgcgatcgtcgacgacggcacggcgccgcccgcgaacctggcgggcgggcctcgcatcggcattcgcgtcggcatggacttcccgtggcggtggtgcgtgcccggcagccggtacgtgtcggggcgctgccgcgcacctgatgcgtgccgtacaaatcgcacgcaattcgacctgcgtcacgcggtcgccattattgaccggctaagctgctcttttcgacgttcgatcgagggggcaccatgcggcgggtcgtattcaaccagaagggcggcgtgggcaagtcgacgatcgtctgcaatctggcggcgatcagcgcgagcgaaggattgcgcacgctcgtcatcgacctcgacgcacaggcgaactccacgcgctacctgctcggcgacgccgcggccgacgcgcagccgggtgtcgccgatttcttcgaaaccgcgctgaccttcaacttccgtccggtcgacgtcgcgtcgttcgtccatccgaccccgttcgaagggctcgacgtgatgcccgcgcatccggatctcgacacgctgcacggcaagctcgaatcgcgttacaagatctacaagctgcgcgacgcgctgaacgagctcgatgcctacgacgccgtgtacatcgacacgccgcccgcgctgaatttctatacgcgctcggcgctgatcgcggtcgagcgctgcctgatcccgttcgactgcgacgatttttcacgtcgcgcgctgtacacgctgctcgagaacgtgaaggagatccagcaggaccacaacgcggcgctcgaggtggaagggatcgtgatcaaccagttccagccgcgagcgagcctgccgcagcggctcgtcgacgaactcgtcgaagaagggctgccggtgctcgcgtcgaggctgtcggcctcggtgaagatccgcgagtcgcatcagcagtccaggccggtgatccatctggagcccgggcacaagctcgcgcaggagttcctcgcgctgcatcgcgaactggccggctgatcttccctgcctgcctgaccagcacgcggccgcatcatgcggccgtttttattgcgacccgcaattcgtccgatcattgattttgtcattaataatcccgaaaacgatttcataataaatccgcaaaaacgattacataagcgactgctccattttcaatgtgtgccggttttctaataaacggaataatgaattggtaaatgttgcgcgacgtcatgatcggctatcctgtaaaaaggtagaaatgcattgcgggacagagtgaagcgccgtctcgtctgcgatgtcggcgcatcacgggttccagcggtcgcccggaattaagataagggtttacacctagtattaatgccatttaattgacaattaatcgatctagaatgggctccttcaacttcccgtgctcaaacaagtgacgggttgtcaataaggaagtctgctgtcgaaccggcttccgattttccttgcgtcgtctctcgcattgccaacaggagcgtgcccgatgtccgtatttgccccgaaaaactcaacgccgattatcagtccggtatcgccgcgtggtttgcgatcgcccgtccggctatccaaggtttcgaggctgtcgtcgaactcaacctgcaagcggcccggacggcgctcgaggaatacgaagacaagctgaagaacgcgttcaacagcagcaatccggccgtgggcttcgcgcagcagatcgccgtgccgcaggaagcggccggcaaggccgtgtcctacggccgccacctgttcgacatcgcggtgtcgacgcagtccgaatgggcaaaggtcgcgcaagcccaatacgaacagaacgacaagcgcctgaaggacgtgctgggcgagctgtcgaagcacgcgccggccggctcggcgccggtggtggccgcgctgaactcggcgctgtccgcggcgaccgccgcggccgactccgtacgcgcagcgacggggcaggcgatcgaagccgcccagagcggtttcgacgcggtcaccgaaacggcaacgcgtggcgcgaagcaaacggccgccgccgcgcgcaggacgccgcggccgcccgcgaatcggctgcgtgatcgcttagccgcgcaagcatgtgtcgcgcacgggcgcgacacgattgatcggcgccggatggcgccggacgccgcgtgtgccgcgcggtgtccggctcacgtccggtttgccgcagcgcgccggtgcccggcgagccgtgcaggtgtgccgcccgtgcggacgggggcggttcgccgtacggaggcatgcgaccgctaccgtgccggatggcccgggagcgcgttcgccggccgagaccggctcgcaccggcgtcggaacgacgaactgatttcaatgcaggaactggacatgacggacgtagtgatcgtatcggccgcgcggaccgcggtcggcaaattcggcggttcgcttgcgaagattgcagcacccgaactgggcgcgacggtgatccgcgcagtgctggagcgcgcgggcgtgaagcccgagcaggtgagcgaagtgatcatgggccaggtgctgacggccggctcgggccagaacccggcgcggcagtcgctgatcaaggccgggctgccgacggcagtgccggggatgacgatcaacaaggtgtgcggctcgggcctgaaggccgtgatgctggcggcgaacgcgatcgtcgcgggcgacgcggacatcgtgatcgcgggcggccaggagaacatgagcgcgtcgccgcacgtgctgccgggctcgcgtgacggcttccggatgggcgatgcgaagctggtcgacacgatgatcgtcgacggcctgtgggacgtgtacaaccagtaccacatgggcatcacggcggagaacgtcgcgaaggaatacgggatcacgcgcgaagagcaggacgcattcgcggcgctgtcgcagaacaaggcggaagccgcgcagaaggccggtcgcttcgacgacgagatcgtgccggtgtcgatcccgcaacgcaagggcgagccgctgcagttcgcgaccgacgaattcgtgcgtcacggcgtgacggcggagtcactggcggggctgaagccggcgttctcgaaggacggctcggtgacggcggcgaacgcgtcggggctgaacgacggcgcggcggcggtgctggtgatgtcggcgcagaaggcggcggcgctgggtctgacgccgctggcgaagatcaaggcctacgcgaacgcgggtgtcgatccgagcgtgatgggaatgggcccggtgccggcatcgcgccggtgcctggagcgcgcgggctggacgccgggcgacctggacctgatggagatcaacgaggcgttcgcggcgcaggcgctggcggtgcacaagcagatgggctgggacacgtcgaaggtgaacgtgaacggcggggcgatcgcgatcggtcacccgatcggtgcgtcgggctgccggatcctggtgacgctgctgcacgagatggccaggcgcgacgcgaagcgcgggctggcgtcgctgtgcatcggcggcggatgggcgtcgcgctcgcggtcgagcgcgcctgagcggggcctgacgattcgtcccgctgcggcgccggtgagcgccgcacgcgggtgaagcggttttcgcgcacgacaagtggccaacaacaagcgcgaggtgccggtgcgtgccgtgcccgcgacgcgggcggctgcgcatcgaagcggtggggcggcagcatgtgcgatgccgtcgccccgctttcatcgattactttttgtcggtaatttacaggatgactaagcgaattgcagttgtgactggtggaatgggcggcctcggcgaagcggtcagcatcaggttgaacgacgcgggccaccgggtagtcgtcacgtattcgccgagcaacaccggcgcggaccgctggctgaccgagatgcatgcggccggccgcgagttccttgcgtatccggtggacgtggccgaccacgattcgtgccagcaatgcatcgagaagatcgcccgggacgtcggcccggtcgacattctcgtgaacaacgcgggcattacgcgcgacatgacgctgcgcaagctcgacaaggtcaactgggacgcggtgatccgcacgaacctcgattccgtgttcaacatgacgaagccggtctgcgaaagcatggtcgagcgcggctggggccgcatcgtcaacatctcgtcggtgaacggctcgaagggttcggtcggccagaccaactacgcggccgcgaaggccggcatgcacggcttcacgaaatcgctcgcgctcgagatcgcgcgcaagggcgtgacggtgaacaccgtgtcgccgggctacctcgcgacgaagatggtcacggcgatcccgcaggacatcctcgactcgaagatcctcccgcagattccggcgggccggctcggcaagcccgaggaagtcgcggcgctggtcgcttacctgtgctcggaggaggccggcttcgtgacgggctccaacatcgcgatcaacggcggccagcacatgcactgactcacggcggcccggacggcgtgcagcccgtgccgggccgtgttccgctggttccagtgccgcagcggcacaggtgtgccggtgcggccccgcattccggagaaggcatgagcgacacctggatgggactcgcgatcggcggcgcggcactggccgtcgcgctggcgatggcgatctcgctcttctggctcgagcggcgccgcgcgctgctgcggaacttcgatcatcgcgattgctggctcgtcgcttacggcaagtgtttcgcgcgcgtgcgggccaggccggcacgccgcatgcgcggcgcgcgttgacggcagcggcatggcggcagtcacgcgtcaccgtcgacgcgcggccacgcatcgcgcgcatgccgcaaggcggtacgcgcgatgtccgtcgtcaatcgctcaatcgctcttttcgctctttccacccgactcgctggagccgttcttgtggaagatccgcttcgtcgtgcgcttggtggcatcccacccttcgcgcgacgcatgcgcgacccgtgcccgaccgccttcgccgcacttgcggtcgcgtggccgaagctgcgggccgcctcgccggtcttgtgcgcggcttccttcgaatcgcgcttgatgtcctgcttcacttccgacatgtccgcgtgcgcgatcgggctgatcagcgccagaacgagcgcggtaccaatgaactgacgaactttcacgacctggtttccttccgttgaacaagcctcttcagcgaggattcgcatcgccggcgggcgccgggcgaaacacgccggccgccgatgcgtcgagcatcaccgcggcgcggccggacagcagcacgcgctcgccgcagcgcagcgcgaagccgtacagcaccgagcgggcgtcgccgctcacgcgttccgcttcgacgacgagcggctgcgcgaacgtgtcgagccggtcgacgaacgcgtcgacgttgcgcacgctcgccagataaccgacgcgcgggcgcgcttcgtgcgcaccgagcaacgcgccgtgcacggccatcgcctgcgccgcgtattcgatgccgcagacggaggcgagccggccgtgcgcgcgcagcgggttgtgcggatcgcggtggctcgtcgcggtgcagcggatgcgggcggcatcccacgcatcgaccgtatcgagcacgcacatcgcgccgtcgtgcggaatgtgcgcggcgatccacgcgtggtcgagcggcggcgcgagcgggatcgtcgcggtcatcacgcacgctccgcgaacgtatccggcatcgcgacatcgacctgcacgcgtgtatcggccaggtagtcgagcacgacgcgtgtcgaacgccgcgcggcgagcgcctcgagcagcggcagcacgcgcgcggccggattgccggcgcgcagcgcgtcgagcccggcgtgcgcgagcgtcgtggcgggtgtgtcggtgagttgcacgtcgatgcgggcgagcgcgtgttcgcttgcttccggcgcgagcacgagcgcgacgccgaacgcatcgtcgatcggccgcaccgcgcgcagcggttccggatagtcggtgtcgtacgcgatcagcagcgtcggcacgcgatcgacgacgacctggcacaggctctcgagcagcccggcggcaaagctgccgtcgtgcgcgcacagcacgttcgacgtcgccatcgcgcgggtcgcgatgctccagtagccggccggcgcgttgtgcacggagttgtggaagcgcgtcggcgacaactggcgatcgtcgccggcgagggtttcgcagatcgcgtggcagttctggccgtcgccacccgacgcgctgaacacggtcgcgagcgtcgcggcgtcgcgtgcgctcgcggccaccgcttcgtggccggccgcgagcgccgtgcgcacgacggggcccgtgcggcgccgctcggccgacggcaggccggccggcggcggcagctcggtgcgggcgggcgcatacggcgcgtggcccgcgagcacgtcggccgcgtgcggccagccgttcaatcccgggccgacgaggccgatgctttcgatgaaggcggtcagtgtcatggcgggcctcaacggcgtgcgtggtcggcgcggccgaggatcaggctgcaattcgtgccgccgaagccgaacgaattggagaggacggcgcgcacgcgcgcatcgcggctcgcgagcacgtagtcggcgacgagtgtcgggtcgggctgcgtcgtgttgacgccggccggcacgaactgttcgcgcagcgcgagcgcggcgacgaccgcctcgagcgcgcccgccgcgccgagcgtatggccggtcgcgcccttcgtcgagctgcacggcgtgccggcgaacagcgcgccgatcgcgcggctttcggccgcgtcgttgctcggcgtcgcggtgccgtgcaggttcacgtagtcgatgtcgttcgcgccgaggccggcggatgcaagcgcctgctcgatggcgacgcgcgcgccgagcccgtccggatgcggcgacgacatgtgatgcgcgtcgctcgattcgccgatgccgagcagcaggatcgcatcggcgtcgagcggggcgggcgggtcgggcacacgttcgacgagcgcgaacgcggcggcctcgccgatcgagatgccgtcgcgcgcgacgtcgaacggacggcacggccggcgcgacagcagttcgagcgaattgaagccgtacagcgtcgtcaggcacagcgaatcgacgccgccgacgacggccgcatcgatcaatcccgcctcgatcatgcggcgcgcggagccgaacactttcgcgccggacgagcatgcggacgagatcgccatcgccggcccgcgcagcgcgaaaacgcgcgcacgaacgcggccggcgaatacgggttgtgcgtgtgggcgtagcggaagtcggcgggcagtgcgccgctcgccgggtcgcggcgttggtacgcatgctcggtctcgaggatgccggccgtgctcgtgccgacgaacacgccgacgcgtgccgcgccatggcgcgcgacggccgccgcgacgcgtgcgtcgaagccgtcctgcatgaggccgagctgcgcgaggcggttgttgcggcactcgaagtcggcgaggtcggcgcgcacgggctgcgcatcgacgccgtccaccgcgccgatccacgtgtcgagatccgcacgctcgaagtcgcagggcgtgagcccgccgcgcgcgtggcgcagtgcatcgagggtcgcgtcgaggccgcggccgatgcagctggtggcggtgaagtgcgagagcaggagaggtttcacgagggtcgcatccggtggccggaacgggcgccgcagcaggctggcaggcgcgccgctcgaggtcagattttatcaaacgggggccgaaccggccggctcgcgtggcccggccggcggttcgggcgcgagcgccgcgcgcagcgtgacccagtgcagctgcgcgtcggcggccgcgcgcagcaccgcgtgcagcacgtcgagcacgaccggttcgccgcgcgcgtcgcgcgccgcgtggccgtcgtgcacgagcaggatgtcgcgcggcgcgagaccgtgcagcaggcggcgcgtgacggtcgcggcatcgtgcgcgcgcgtgtcgaaaccgcgccgcgtccagctcgccagctgcaggccgagctcgcacagcaccggttcgaggaacggattgcgcaggccggccggcgcgcggaagaacagcgggcgcgtaccggcgatctcggtcagcgtccgttgcgcggccgagatctcgcgccgcagcgcggcgggccccgacagcgagaacgtatgccggtgccgctggctgtggttctcgatcgcgtgaccgcgcgcgacgatcgcctcgatccagcgcggatgacggcgcgcgagatcgccgatgcagaagaacgtcgcgcgcgcgtcgtaacggtcgagcaggtcgagcacgcgcggcgtgacgtcggggtccgggccgtcgtcgatcgtcaatgcgatgcggcggccggcgcggggcggcaggcgcgtccagttcggcccgagcagtgcgctgcgcggccacaggccggcggcggtcagcgcgagatgcgacgcgaccacgccgccgacggcccacggccacacggccggctgcgcgacgacggcggctgccgcgcccgcgtgcagcgcggcggtgcccgcgatcagcggcgtgggctgccagcggcgcgcatcgccgggctgtcggtgcggaatggacgacggtgcattcatgcgcggcttccttgatgacggttgccggctgcggccgcgcgcggcgcgagaatcgccgcgaacgcgagcgcgagcatcgcgcccgggccgacggtcagcccaaaggtttcgagcagcggcacgcgcgacagcgccagcagcccgaagccggcgaccgtcgcgaggttcgcgatcagcagcgacacgagcgtgcggggcgtgacgggctgggcgtcgtcgcgcttgcagaagaacagcgcgtagttcgagccgaccgcgacgatcagcagcatcccgacgaggtgcaggatcgtcagcggcacgccggcgagcgcgaagccggccgtcacgaccagcacggccgcgacgagcggggcgagtgcgcgcacgacacggcgcggcgagcgcagtgcgatcagcagcagcacggcgatcgcggcgaaacccgcgagcgacagccggatgtcctcgtgcacgtagctcacgtacaggcgatcggcttcggccttcatgtcgacgaacagcgcatcgggcacgcccgcgcgcgcgacggccgcgcggatcggtgtcgcatcgagactcgatgccggttgcgcggtgcgggcggcgtctggcgcgcgcagcggcagcatcgcgctccagcggccgtcgcgttcggtcagcagcgcatcgacggcgagcgccatcgacgtgccgcgcaggtccgcgcgcgtcagcagccgcgcgtggcgcgcggcttcgacgtcggcgatgaacggtgcgaacaggtcgggcctgaccgcgatcggctggttcgcgacggcgtcgtgcatccgcgcggcgagcgcatcggcatccggcaggctcgcgaggcgcgcgctgcgcggcgtcgctcggcaggaagcgcgcggggtttcgaaacccgcgagcgcgccccggtcgacgagcggctgcaactgcgcggcgacccgttccgcgcgttcgagcgcggcctgttcggtcggcgcggcaatcacgacgaggtagcgcacgtcgggcgcgccgacatcggcgcgcagccgtgcgtcgagcgcctgcgcttgcgcgggcacggggctcagcgcggcgagttcgcggctccacaggccgtcgcgatgcagcacgagcgtcgcgcccgcggcgatcaccagcatggcgagcggccagcgcagccgcggcgcggcgtcggccgcgcgcgcgagcacggcgccgatgcgcgacacgtcgcggatcgcgacatgctcgccgcgcaggtgcggcagcacgaagcgcgtgacgagcgcggcggccgtcagcccgacgatcgaatacagcccgagctgcacgaggccgggaacccggagaacagcatcgacgcgaaaccgcacacggacgtcagcacgccgagccggatcgtcggccagtacgcggcgacccaggcgcgcgtcgcgtcggccgggcgcgccgcgccgcgcgtgccggcctgcgccgattgcacgaacaggtagatcgaatagtcgacggcttcgccgatcagcgtcgtaccgaaaccgagcgtcagcccgtggacggtgccgaacgcgacgctgaccgccgcgattcccgccgcgacgcccgtcagcaccggcagcaagccgagcgcgagcgtgcgcggcgaacggtacagcgtcagcagcaacgcgacgatcagcacgacgctcgccgtcgacagccgttcgacgtcgtgccggatcgtgtcgcgcgtgtcgaccgagaacacgccggggcccgtcatcgcgagcgtggcggcggcggcgttcggcatggcctgcttcgaggcctgctttgcggtctgctttgcggcggcgaacgcgcggcgcaccgcgtcgatcgcgcgggcctgggcatcggtatcggaaccggcggcggccgtctgcacgacgagtaccgcgcgggtgccgtcgcgcgacgcccacacgccgtcgcggctcgccggttgcgccgcgccgtcgagctggtcgacgagcgcggcgacttcgccggtcgggtcgcgcggcagcagcgccttggccacgaggccggccgacgagctcagcaggtcgaggctgtcgccgagcgcctggtgcaggccgtcggcgctgaagcgctgcggcgtgacggccgggctcagcagatagcggtgatcgaagatgaactgccggtcgcgcgcgtcgttcgccgcttcgccgttgtgaaccgccgcgaactgcggatcggcgcgcagcgtgccggccacgcgccgcgacagcgcggcgcgcgtggctgcatcgccgccttcgatcgcgacgaggatcagccgcgacacgatgccgtcgcgcaactggtcgacgagcacgcgctgcccggcgctcggcgaactcggcaggaacgcggacaggtcggccgtgaagtgcgcgcgcccgatcgcgatgccgcacgcgacgagcgcgagcagccacacgagcaccgcgcgctgccgcagcgcgtgcaggcggcgggcgaccggcgaagacgggggccgggtgcgttcgtccatcagttcgggttcgccggaacgggttgcaggcgcatcaccgaacggtcgccgtcggcctgccggatcgcgacgctgcgcaacaggtcgcgcgtgccgtcgagcgtgatcgtgctgacgaccttcagcatccgcgagtcgagcggcgtgagcgtcagcgtccagtcgtcgccgcgcccggcgagtgcgaccttgtagacctgttcgagcgcgaagcggttgccggcgagcgtcgcgcggatgctgtcgatgaaggcgccgagttccggatagcgcgcgagcgcgagcgtgtacttgcggctgttgcgctcgacggtgagcatgtcgccgtcgacgacgaggtgttcgggcttcgggctcagcgtgtgcttctcgagatggtccggcgcgacgaacacgagttcgccggacgattcgaccggctgcgtcgcgatcgacaggtacttcgtctcggtgaacgtcgcacgccccgacttgtgctgcgcgagcgtcgacatcagccggtcgagggtccacgccggcgccgcgtcggccgcccgggcgggcgcggcggccagcgcgatcgcggcggtgcttgcggcgatggcggcggccagcgtgcggacggcgcgacgcagggcgggcgtgagcgtgggcaggcggcgaacggcggtcatgcgtcggaatccctcgtggcggacaggccggcaccggcgcatgcggcgtcgccgcgcgcgaccgcggtcgcggcatcgccgccgtgccagaagtcgaaatagttgaaccagttgtacggtgccgagcgacagtacctgtcgagcagcgcgacgtagcgcgcgagtgccgcgtcgacggccgccgcgcgcgcgtcgcgccgcacgtcggagaaatcggcgagcgtctcgaagtgcacgtcgtagcggttgccgtcgcgatagaggcccgtcatgaagatcaccggccgtcgcagcatcgcggccatgtagagcggcccgagcgggaacgcggccggcgcgccgagcagcggcagccgccgcagcgacgcggccgcgtcgtcgagcagcgtgcggtcggcgagcatgccgaccatgcagttcgcgtcgaggcgctcgcgcaccttcagcatcgagtcgacttgcccgagcggaatcacttccggctgcgcggcggggttcaccgcggcgagcgtcgcgttgatcttgcgcgcgttcttctcgtacatcgtcacgacgacgcgcaggtccggtgcgtgcggccgatcgcgcgcacgacctcgaagctgccgagatgcgcgcccatcaggaacgcgccgcgtccgcccgcgagcgcttcgtctaccagcgtctcgccgtgcagccggatgtcgaacaggtcgaagcgcccgttcatcaggtagatgcggtcgtggatcgtcgccgcgaacgtgaacacgtgccggtacacgtcgcgccagcgcgcggggcggccgagcacgcggcgcaggtagtcgcgcgacgccgcgcacgcgaccggcgaaaacagcacgaaatacgtcgcgatcaggtgcagcacggcgcgcgcgctgccggccgaagcgcagcgagatccacgtcatcgcgcgcagcaagcccgcattgctgcgctcctggcgttcggcccacgcggtgcgcttcatggctgcgcaccgtcctgcgcggccggcggcgcggacagcacgccgctcgcgacgtcgcgcgccccggcgcgcagcgtgaagcggatcgcaccgccggccgcggcgtcgtacgcgagatcgagcggctcgccgggcgccaccgggctcaggaatttcgcggacccgagccgccacgcgtgcagggggcggttcagcgcggtgccgagcgcatggatcgcgtgatcgagcagcacgacgcccggcacgaccggatggccggggaagtggccgggcagtgccgggtgatcggcggggatcgtgaacccgagtgcgggcgtgccggccggatcgggcacgggcacgggcacgggcacggccgcggggcgcgcatgttgcgcaacgagtgcggcgagcacgtcgcgcggcagcttgccggtttcgttgcgcggcagcgcgtcgacgaacacgagcgggcgcggcatgaacgcgggatcgatccgctcgcgcagcgcgcgcagaccggctgccgtgagcgtcggcgcgacgacgagcgcgacgaggcgcgtgaccggctcgaggcgggtgtcgtcgtgtgccgccgcggcttcgtcgggcatgaagaatacgccgtcgaccacctgcggaatcgcgttgagctgatggttcaggtacgcgagcgacgtgcgcttgccggcgatgttgacgaggtcggccttgcggccgtgcagcaggaaccggccgtcgccgagcagttcgagtgcatcgcccatcggcacgggtgcctccacatgtccgcccgacacccacacggtcgggccgctgtcgtcgtcgtccggttcggcgcgcgcgtcgaggcggatgtccgggaacagttcccatgccgcgccctgcgacgtgcggcgggtggcgatctggccggtctcggtgctgccgtagatctcgacgagcggcgcgtcgagcgcggcctcggcttcgcacgcgagcttttccgacagcggcgcggtggccgacagcacgagcgccgcgggcggcagcgcatggccggcggcgagcagcgcacgcaggtggatcggcgacgtgacgagcacgcgcggttgcgggatcgtgtcgagttcgtcgcgaatgtcgaccgggtagaacggctggcggttgctgaacgcgaggccgccgatcagcgcgagcagcaccgtcgactcgaagccgtacatgtgctgcgcgggcaccgtgccgatcagcgtggccgcgcggccgtcgagcagcccgaggcggtcggccgccgcgcgcacgcagccgaccaggaagccccaggtcttgcggtgcggcaccggcgcgccggtcgagccggacgtgaacacgtaggccatgatccgcgccgcatcgatctgcggcacggcgaacggcgcatcgtccgcgagcgcgccgggggcggcatcgggatacgcgaagcgcggcaggtcgatcgtgcagtcgggcgcgtcgtgcaggcagaacgcgtcgggcgcgaacgacgcgagctggcggaccatttccggcgtatgcgtcgacggcagcaggctgaccttgccggcaacgagcgcggcgcacaggctgaccgcgaagcggtagcggtcgcggcacacgttgaacacgtgcgcgccggcgggcagcgcggcggccacgcgcgcgacgtcggcgacgaacgtgcgcacggtgacgggcgcgccgtcgcgccaggcgatcgtctggtcgggcgacgaatggaaaaccagcgggtgagtcggcatagatcggtcgaaacaggagcgaaggccggcgcggccgcgttgcggcgccgcgccggccgtgaattcatcgtgatgcctgcgacgcgtgtgccgtcgcgcgatacgcgcgcaccgcgtcgaccatgcgcggccgcggttcgtgcggcagggcgaagcgtcggcacgcatgctcggccgcgaacatcacggcgacgagcggcagcgacaggtagttcgcgaatgtcgaccatgtgacgatcggcgcggtcgcgaacagcagcgtcgacacggcggcgatcgcgacgaagaacagcgtccacgcgagcgtgatctgccgcgtgtagtgcgcgacggccggcgtgatcgcgccgtggatcatcgtcgcgaaatgcgtgcacagcggcaccttgccggtcgcgagcgtacggccgaacagcagtgccatcgcgaggttgaaactcgcgtgttccaggtacaggccccattcgaagtgccgggcgagcggcacgcgcgcggccctagcgcggcggcggcaagcagccatgcggacacgaacccgatgcgatgcggcgaacgcagcgccgcgccgagcgcgagcagcagcggcggcacgagcgccatcgcgaggccgaggccgtgcgcgccgggcgtcgcggccgcgtagtgcgcgccggcctggtatgccgcgacggcgccgaccgcggcgatgccgcgtgcgacaggcagcagccggctcatcggcggcctccgtgcgcacggcgcaggtacccgtcaccggcggccgggcggcggcggaaggacgggcgaaccggaacggagcggaaggacgggcgcggcatgactggcgacatcgggcggatcgtggccggacgcgagggtcgggccgtcaaacatcagatgaaaggcggccgggacgggtccgggccggtggtcgggcacgctcattttagggccgcggcaccgcgtgttcggagcgggcgcgaacgggttttgtaaccgattgtatggcgccggacgaacggtttcgcggggtcggttcatttccatccaaagcggctcaagcatctggtgcattcgggtcccgcaacggggcgccgcgccggcccgccagtctgtaaccattggcggtatcggcccgatacccgttcgtctagaatccgcgtaacttttacaaacgatccccaaaaacgcaggcgggaagccggcagacgccggagggacggagattcgcacgcgccgggcgtgcatggcgattgccgtttccgggcgccttccgctgccacgcgccgcctgcccgcacgcatgatgaacgcactggaacaagagctcgccacgctgatcatcggcgaactgaatctcgaagacgtcccgctcgaaacagtgacggccgacaccccgctgtacggcgagggtttcgggctcgactccatcgacatcctggaaatcgcgctgctgatctcgaagaaattcggcttcgagctgcgttcggacaatccggacaaccagaagatcttcgcgacgctcggtgcactggctgcgtacgtcgccgcgcaccgcacgaagtgacggcgtcgcgcacgggcgcggcgcgcagatgaggacggcacgcggccgcgatcggcagacgatacgcggccgcgtcgatcgaggtgaaacgcgatgaacggagcaattcgatgcgggcgctcgtgacgggcggcagcggcgcactcgggcaggcgatctgcacggcgctcgcgcaggccggccatgaagtgtgggtgcatgcgaaccgccatctcgcgcaggcggaagcggtcgcgcagcagatcgtcgcggccggcggcaccgcgcgcgcgatcgcgttcgacgtgaccgacgccgatgcgacgctcgccgcgctggcgccgctggccgacgatgcgccggtgcagatcctcgtcaacaacgcgggcattcacgacgatgcgccgatggccggcatgtcgcgccggcagtggcacagcgtgatcgacgtgacgctcaacggcttcttcaacgtcacgcagccgctgttgctgccgatgatccgcacgcggcgcggacggatcgtcaacatcgcgtcggtggccggcgtgaccggcaatcgcgggcaggtcaactacgcggccgcgaaggcggggctgatcggcgcgacgaagtcgctgtcgctggagctcgcgtcgcgcggcatcaccgtgaatgcggtcgcgcccggcatcatcgaatcgccgatggccgaacaggcgtttcccgccgaacgcatcaagcagctcgtgcccgcgcagctcgcgggccggcccgacgaagtcgcggcgatggtcgcgtacctggtatccgacgccgcggcctatgtgacggggcaggtgctgtccgtcaacggcgggctcgcatgacgaggcgcgcggcgtcggcgtgacgtaatgcaacgcggcatgacgcaacgcagcgcatgccgcgaagttgcgcggccagcgccgcatagtgaggaaatcgaagtgtccgtgcatccagtcgacgccgaacggcgcccgtgttccctgtcgtcctccgctgcgccgttcgcgcgcgggcaggcggcggccgggccggccgcatcgcgaccgggcgtgccgctcgcgcacgacgagggccgcgcgctgcggctcgtccggatgagccatgcccggctcgccgcgttgctgcacgatgcacgcggccgtggcgacggattcgaccgcgtgttgcccggcgcactgggcgcggtgtgcatcggcgcgggcgatctgcagcgcgcatcccgaaccggctcgcacgcggacgcggcggcgcggatgctggccgaagtcgtgcccgacctgccggtcgcgccggtgccgatggcgctgctcggcgccggcatcgcgccggacgacgccgtctgcgaaatctggcaatgccgtgcgcgcgacctgcgcagcgaacgacacggcgcgctgcactatcgctacagcgaaacggcgggtctcgtgttcggcagcatcgtcgtgcacgagcacgacacgcccgacgcgcatcgcgacggcggcacgccgctcgaacgcgcgacgcacgatgcgtaccgcgcgctgttcgacgtgctcgattcgctcggcatgccgcatccgctgcgcatctggaatacggtgccggcgatcaatgcggtgcagttcgggatcgagcgctatcgtcagttcaatatcggccgccagcatgcgttcgacgcgtgccgccgcgcgctgacgggcggcgtgccggccgcgtgcgcgctcggttcggtcgtgccggtcgcgggcgatgcatcgcccgccgcgccgctcgcgatccatttcctcgcgagccgcacaccggccgatccggtcgagaacccgcgccaggtcagcgcgtatcactatccggctcagtacggcccgcgggcaccgacgttcgcgcgcgcagccgcatggccggcggacgatggcgcgccggtgctgttcgtgtcgggcaccgcgagcatcgtcgggcatcgcaccgtgcatctcggcgacgtcgtcgcgcaaacgcgcgagacggtcgcgaacctcgcggccgtgctcgagcaggccgcgcgccagggcacggcccgttcacgctcgccgacctgagctatcgcgtctacgtgcgcgacgccggcgatgccgcggcgctggccgcgatcgggcaggtgctgcgcgatgcggccggccccggcgtgcggccgctcgtcgtccatgcggacgtgtgccgcgacgacctgctggtcgagatcgaggccagcgcgggtcatgaggaggcgtggctgtcatgaagcgcgagagcctcacgatccggcaaccggctccgcattcgggcggcgtcgacgaagcctgccggcgttcgccggcaagtcatacactttgtcaggatccccgtcttcgcaatcggccgtttccatgtccaagcagcacgcctcgtccacccatctcgtcctgattccgagctacaacccgggcaccaaggtcgacacgaccgtgcgcaatgcgcgagcgcagtggaatccggtgtgggtcgttgtcgacggcagcaccgacggcagcgccgaacggctgcaggccatggccgaacgcgacccggggttgcgcgtgatcgtgctgcccgagaaccgcggcaagggcgcggcggtgctcgccgggctcgacgcggcagccgcgagcggcttcacgcatgtgttgacgatggattccgacggccagcatccggccgacctgattcccgctttcatggccgcgtcgcaggccgcccccgacgcgatggtgctgggcgtgccgaagttcgatgcgagcgcgccgcagttgcgcgtgcagggccgccggctgtcgaacgcatgggccgacctcgagacgctgtgggccggaatcggcgattcgctgtacgggtttcgcgtgtacccggtcgcgccgctggccgcgatcatgcgccgccagccgtggatgcgcggcttcgacttcgatcccgaggcggccgtgcggctgtgctgggccggcgtgcgtccgatccgcatcgacgcgccggtgcgctatttcggccgtcacgagggcggcgtctcgcacttccactacggccgcgacaacgcgctgctcgcgtggatgcacctgcgccttttcaccggcttcgtggtgcggctgccgatgctggtcgcgcggcggttggcgcgacgccacgatcagacggcctgagcacacccgatttcgatgccggtcgtcgcccggtcgcggcgattgccccgtttttgtcgtcaatcccgcgccggcgcaccgcttcattccagttcgctgagtaatgaacgtgtcatccgatgtaaacatctggtaattttctgccggattatgcaaaatcgccgctcccaaataaaactatcgagggatccgggatgcaactcaagaaagcggtggcagcgtgtggcgtggcgtttctgttgagcgcgtgcggcggggtacagagccttgacgcgaacagcctgacgtcggcggggacgagcctgtacaaggcagcgacgttgtcggatgccgacatcgccgcgctgtcgaacgattcgtgcaagtcgagcgatgcggaatcgaaggtcgcgccggcgaacagcgcgtactcgaagcgtctgacgaaagtgatgaagggcttcggcgacatgacgctgaacggccagaagatcaactacaaggtctacatgaccaaggacgtcaacgcgtgggcgatgggcaacggctgcgtgcgcgtgtacagcggcctgatggacatgatgaacgacgacgagctgcgcggcgtgatcggccatgaaatgggccacgtcgcgctgggtcactcgaagaaggcgatgcagacggcctacgcggtcagcgcggcgcgcaccgcggccggcgcggcatcgccgggcgtggcggcgctgacgagctcgcagctcggcgacatcaccgagaagttcatcaacgcgcagttctcgcagacgcaggaaagcgcggccgacgattactcgttcgacctgatgaagcagaagaacatgaaccagaagggcctcgtcaccgcattccagaagctcgcgcagctcgatggcggcaagagctcgatgatgagctcgcatccgtcgtcgtcgagccgggcgcagcacatccaggatcgcatcgcgaagggcagctgatcgccgcccgatgcgccggcttcgtccggcgccctggatgaacgaaaccccacgcttcgcggcgtggggtttttgttttcggggaccggaaaacggccggccgcttgcttacggcaccatccccggcaacacgtacgcctgcacgagcgtgatcaacccgacgatcaccgcgaacagcaggctgtggcgcacggtgaagcggaacagctccgactccttgccgacgaggcccgttgccgcgcacgccaccgcgatcgactgcggcgagatcatcttcgcggtcacgccgcccgtcgtgttcgcggccaccgcgagcgtctcgggtacgccgagctgatgggccgtggcctgctgcagcgagcagaacagcgcattcgacgacgtgtccgagcccgtcaggaacaccccgagccagccgaggaacggcgagaagaacgggaacgcggcgccggtcgcggccagcatcagcgcgagcgtcgacgacatccccgaatagttcgcgacgaacgcgaatgcgagcacgaggccgatcgacaggatcgggcgggtcagttccttcagcgtctcgccgaacgtgacgagcgcgtcgcgcggcttcatccgcagcagcaccatcgagatcagcgcggtcacgaggatcgcgctgcccactgccgacacgagatcgatcttcagcacggcgtcgagcgccttcggcgtcgcggcgatcggtgcggtcttcacgacgagctggtcgagccccgccacgtggaatttcagcacggtcgacgcgagcgcgccgtgggcggcgaacagcgccttgaacggcgcgatgctccacacggtgacgacggccgtcaggatcaggaacggcgaccatgcgcgcacggtctgcgcgagcgtgtacggcgatgcctgccggctggtgcccgcgctgaagccgttgcgcgaacccgcgccgccgaagcccgcgagcgcggcgccgccgcccgacgcgacgacgctgccggccgtctgcttcgcggtgcgcggctgccagaccttcaggaacgcggcgagcgcgacgaggctgacgagcgacgacgtgatgtccggcagctcgggcccgatgtggttcgacgtgaagtattgcgtcaccgcgaagctgccgcccgcgacgagcgcggccggccaggtctgccgcacgccgcgcagcccgtccatcatgaacacgagccagaacggcaccgcgagcgacagcagcggcaactggcggccggccatcgcgccgatatggaacgggtcgatgcccgtcacctgtccggcgacgatgatggggatccccatcgcaccgaacgcgaccggcgcggtgtttgcaatcagacacagtccagccgcgtgcagcggcttgaagccgagcccgacgagcagcgcggccgtgatcgcgacgggcgcgccgaagccggccgcgccttcgaggaacgcgccgaacgagaagccgatcagcagcatctgcaggcgctggtcgtcggtgatcgacagcacggacgcgcggatgatgtcgaactggccggtcttcacgacgatcttgtacaggaacacggccgcgacgatgatccacgcgatcggccacaggccgtatgcgaagccgaaaccggctgccgcgagcgcctgcggcacgggcatccgtatgcgaggatcgcgacgccgagcgacagcagcagcgtgatcgccgcggcgacgtgccccttgagccgcagcgcggccagcgcgacgaaaaagaaaatgatcgggattgcggcgacgaacgccgacagcccgaggctgccgagcggcgtatagatctggtgccaaacctgcatgggtgtctcctccatctgtgtctgtctatctatgggtatgggtgggtaaagcggggctactcgggctggccgcgtgcgcgcagcaggtcggacaggctgcgcggtgccggttcgagcggcgtgcggtgctgcgtccagcccatctgtttcgcgggtgtcagcgcacgcaggcgcgtcgcggtccagcggaacgcgcggtatgcgcgcggatgcgcgaacgcgcccgaccagaagcgccacacgaggtcttccgcgcgggtgtagttcgcgccctggccgcgcagcggatgcgcgacgggttcgtcgggcttgcggttcgcctcggtacgcagccgcacgagcagttgcgggatcgggattcgcaccgggcacacctcgccgcatgcgccgcacagcgtcgacgcggtcggcaggtcggccgtcgcgtcgaggccgagcaggtgcggcgagatgatcttgccgatcgggcccggataggtcgtgccgtacgcgtggccgccgatgcgcgtgtagacggggcagtggttcatgcacgcgccgcagcggatgcactgcagcgtcgcgcgcagctgttcgtccgcataggcttgtgtgcggccgttgtcgagcagcacgagatgcagctcgcgcgggccgtcgcgttcgccgtcgcggcgcgggcccgagatcaggttgaagtaggtcgtgatcgcctggccggtggccgagcgcgtgagcaggctcgacaagggcacgatgtgctcgagtttctcgacgaccttctcgatccccatgatcgcgacgtgcgtgtcgggcaccgtcgtcgacaggcggccgttgccttcgttctcgacgagccacagcgtgccggtgtcggccgccgcgaagttcacgccggacaggccgatgtccgcatcggcgaacgcgcgccgcagggcgcgccggccggtctggatcagttcgtcgacgtcttccgtgtaacgcgtgccggggatgtgcgcctcgaacagttcggcgatgtcgccgcgcgtcttgtggatcgccggcatcacgatatgcgacggcttctcgcccgcgagctgcacgatgaactcgcccatgtcggattcgatgcagtcgacgccgtgctccgcgaggtaatggttcagctcgatttcctcgctcgccatcgacttgcccttgatcacgcggcgcgccttcttcgcctgcgcgatgccgagcacgatcgcgttcgcgtcggcggccgtctcggcccagtgcacgtgcacgccggcctcggtgagcttcgtctcgagccgttcgagcagcgcgggcaactgcgcgagcgcgtgctgacgtacggcttcgccgaggtcgcgcagctgctgcagctcggcgtcgtcggggaactgcgtcgcgcgcttgccctgcaaagtccatcgcgccgcgaaagctccggcgcaatgcgggatcgtcgagcgcggcgcgcgcgcgggcgaagtcgccgggggcgacgaagtgcagcgtgtggtcgctcattgtgggaggtcctcgcgggcggttgcagccggccgggcggcggaatcggtgacgatcacgacccacaggcggcgcgggccgtgtgcgccataggcgagcgtctgctggatgtcggacgtcttcgacgggcccgacaccagcacgaggttggtcggcatgccggcgtgccagtgctctgcatgcacggccgcgtgcaggtcgggatgcagtgtgttcgcatggacgagcgcgacatgcagcggcggcaccagcgacaccgtgcgcggcgtgccggcatcgggggcgagcacgacggtgccggtggccgtgatgcccgaacgcgcgacggtgaagcccgcgtcgatcgtgtcgaacaggtcggccttccacgcgtcgatcggccggtcgaacggcacgggcgcaaccgtgtcgggcagcgcgcgggcgagcgccgcggattcggcgcgggccgggtcgagcagcagccggcgcacgccggcttcggcgagccgcgcggcgagctgcgcgggccatgcatcgccggtcgcgcaccagacgtccgcgtgcgacgcggcgagcgcggcctgcatcgtgcgggcgagcgtgtgcggatccgcggtcccggcctgcgagcggcgcgtgtcgtaatgcgtgtcgatgcgtgcgtcgagcgtgcggccggacgttgcggcgacgcccggcgcggcggcgcgcagccgcgcgaggatcgagtcgcgcgcgctcatcgctggtctccgcgcagcgacggggcgttcgcggtgcgccgccacaggaagctggcgaggtgttcgaccggcagcggcgcgccggccttggccgccgcgtggccgatgttcagcaggcagccgcagtcggcggacacgagccggtcgcagcccgtcgcgcaggccgacgcgaccttgtcgcgcaccatcgcgccggagatgtcgggatgcttcagcgagaacgtgccgccgaagccgcagcattcggattcgcgttcgtgttcgacgcgcgtcacgcccggcagtgcgtcgacgagcgcgacgccgtgcccgcgcgtgcccatctcgcgccgcgccgcgcacgacgtatgcagcacgacgcgttcgtcgggcccggcgccggccgtcgccgtgtcgagccgcacgtcgagcacgtggacgaggaattcggcgagttcataggtccgctccgcgaccgcgcgggcttgcgggccgcacacgggatcgttggcgaacagcgccggccaatggtggcggatcatcccgcgcacgagccggagggcacgatcacgggccacgcttgcgcgaacaggtcgagctgcgcggccgcgacgcggcgcgcttcgtcgggattgccgctgctgtaggccggctgcccgcagcagctctggccgcgcggatagtggacggtcaggccttcgcgttccagcaggcggaccgcgtcgagcccggcttcggggacgaacaggtcgaccaggcaggtcgcgaacagatagacgtgcgcgggggcggcggcggggtattgcctttcgttcatgtctcgctccagtggcgacggcccggcatgcggatgcgggacgacgatttcgctgcataattcccgcgacggcgctgcggctcaaattggttgggccaatcggcgcggcacgcattgagcgggagacgcgacgatggcagcgatgacggcacggggccggaccgaaggggtgatgcgcaagatcgagacggcactgctcgacggcacgtggccggccggcgcacgcctgccggccgagcgcgtgctcgcgcagcagtacggggttgcgcgcaatacggtacgcgaggcgacccagcggctcgtcgcgcgcgggctgctgcagagccggcgcggcgcgggcgtctacgtgacggaccagttgcgcgccggcatcgcgtcgccgtgggggcagctggttgccgatcaccccgcgctgcgcgacgacatcctcgaattccgccgcgtgctcgaaggcgcgaccgcgtatttcgccgcgctgcgcgccgacgcgcacgaccggcgccggatccgtgcgctgctgcgcgagctcgaaaccgcgcacgcgaacggcgcggcggccgtcgaagccgcgaccgacgcgaagctgcacgaggcaatcgcgctcgcgtcgcacaacacgatgttcctgcacctgcatacgagcgtgatcgggatgctgcgcgaacacatctcgatcaacgtggcgggcatgacgacgcacgacgagcacgcatccgaactcctgctgctgcagcaccgcgtcgtgtgcgacgcgatctgcgcgcagcggcccgaagaggcgcgcaccgcgatgcagacccatatcgactacgtgcgcagccatttcgagcgcagcggcgacgaggcctgagattggtcggactacttcggtgcgaggcccgcccggcgggcacttccggtgcggcgggtctcgatgcccggcacgcgcgcgcacgcctgcggttcgaggccgtcggtgccgcccgcgcgattgaccggttcatcgggcgcctactagaatcggccggaaccgcgcgccagccgcgcgccgcggcgcatgcgggccctgtgttccgccagtcgaggaagtctccgtgttcacgtccctgatccggcgcgcaccggccgcgctgtcgtggcgcgccgcatgccgcccggcccgcgcgctggccgccggcgtactcctgtcgctcgtcgccgcgtgcgcgacgcatccacccgccaccacgctcgatcgcccggtctcccttgcgttaccgcccgataccgcgacgccgttgcgcgatgcgctggccgcgcccgaggccgcgcatccgggccagtcgggtttccggctgctggccgacggcgcgcaggcgttgcagatgcgcatcgcgctcgcgcgcgccgcgacgaagacgctcgacatgcagtactacatcgcgaccgaggacacgaccggcaagctgctgctcgccgcggcgctctacgcggccgatcgcggcgtgcgcgtgcggatgctggtcgacgacctgaatttccgcgacatcgatcgcgtgatggccgcgctgaacacgcacccgaacgtcgagatccgcgtgttcaacccgttcggcgcatcgcaggggatggtcgagcgcacggccaacttcttcacgcgcatcgacagcttcacgcgccggatgcacaacaaggcgatgatcgcggacaaccagatcgcgatcgtcggcggccgcaacctcggcgacgaatacttcagcgcgagcccgacgctgcagttccgcgatctcgacgtgctcgccgcgggccccgtgacgaacgacagctcggcgagcttcgacacctactggtcgagcgcgagcagctatccgctgcgcgtgctgaatcatcagtcgttcgatacgaaggatctcgacgcgatgcgcgacgagctgcgcgaccactggcgcaagaatgccgatccgtacaacgcgaagccgctgaacgcgacgccgctctcgcggcagatcgcgcgcgacgagctcgggctcgtgtgggcgccggccgagttcacggccgacgcgcccgacaaggtcgcgcagccgaccgacgcgtacgtgagcccgccgatgcagcgcctcgtcgaactcacgcgcggcgcgcagcgggaattcctcgcgttttcgccgtatttcgtgccgcacgacgcgggcgtgaagatcctcggcgacacgaccgcgcgcggcgtgcgtgtcgcgatcctgaccaattcgctcgcggcgaccgacgcggtcgccgtgcaggccggctacgggccgtaccgcgtgccgctgctgcagcacggcgtcgagttgtacgagttcaaggcgcagccgggtcgccagcgtccgcgcctgttcgggtcgcgttcgcgcgcgagcctgcacgcgaaggcgtacgtgatcgaccggaagatcctcgtgatcggctcgatgaacctcgatccgcgttccgcgcacctgaacacagaactggcgctggtgatccatagcccggcgctcgccgagcaggtcgcgcagatcttcgcgcgcgcgacgcagccggacgaaagctaccgcgtgagcctcgtgacgccggcgggcggcggcacgcccgaactcgaatggacgggcacggacgacggcaagccggccgtctatcacgtcgatccgcacgcggggctgctgcgcaacctgatgaccggcgtcttcatgctgctgccggtcgacgaccagctttaggggccggaagcgctccggctaaacccgcgtttccggtgcgcgggcaaaggtgatatggttgtgcgcgcaacgagtgtggcgcgcagggcgccgccgccgggcggcccgcgccacgcgggccgcgcacatccgcaaccggagttccccatgcaacgtgtcccgaaccagccgttcacgcgtcccgcccgtttctccgaagccgaatggcaggcgcgcgtgcagctcgcggcggcgtaccgcatcttcgaccatctcggctggaccgagctgatctacaaccatatctcgctgcgcgtgccgggcgaggacgggcatttcctgatcaacccgttcgggctccattaccgcgaggtgtgcgcgtcgaacctcgtgaagatcgacatcgacggcaacgtgatcggtcattccgactggccgatcaatccggccggcttcacgttccacagcgcgatccatgcggcgctgccggatgcgcactgcgtgatgcacgtgcacacgacgccgacgatggccgtgtgctgttcgcgcgacgggctgtcgttctcgaatttctattcggcgcagctgtacgggaagatcgcgtatcacgacttcgagggcatcaccgtgcatctcgaagagggcggcgcatcgtcgagagcgcgggcgggcggcccgtgctgctgttgcgcaaccatgggcccgtgacgaccggcgcgacgctcgcgcagacgttctcgctgatgtggctgctcaatcgcgcgtgcgaggtgcaggtcgccacgcatgcgatcggcgacgcactgccgatcgcgccgcccgtgctcgaagggtgcgtgcgcgattcgctgaatttcgatccgaagcatggcgcggggcaggattcgttcgacgcgctgcagcgtatcgtcgatcgcatcgatcccggctatcgggcgtgacgcggggcggcgtgatcgtatcgtcatgcctgatgcggcaggcccagaatctggcggcgggcaaaaaacgcggccgggtggccgcgtgaatactcgcagactccttcggacgaaggaaacaagcaactgtgagatgaagtgtagcgaaaggccgcacgcggattcagccgtcaggctgcaaaggtccattccagcctgaggcagactggcctgccgagcgcgctgcggcgttttgcggcatggccgttcgacgggctcccggatcggcggcgatcgactaccatcatgtgtggcgccgccgttcggtcggcgtacaacgtcgtacaaggagagtccatgctcaagctgcgtttgctccaggtcgcgttactcgcgggtgtgctggccgccggcaccgccgccgccgaaacggtgcgcctgtccgccaatctccagccgtcgagcgaggtgccgccgacggcgaccaagggctcgggcgacgtcgaggccacctacgacacggcaacgcacatgctgcagtggacggtccgttacgaacacctcaccggcccggccaccgccgcgcatttccacgggcccgcgccggtcggccagaacgcgggcgtgcaggtgccgattccaaaggacgagctggcgagcccgatcaagggttcgaaggcactcaccgacgcgcaggtcaccgacctgatgggcggcaagtggtatttcaacgtccatacgaaggagcacccggccggcgagatccgcggccaggtgatgccggcgaactgagcgccggcgtttgatatggcggcacccgtcgagcggtgcgggaacgatcgcacgtaccatcgtcacactgcgaatacggagtgcgtccgatgagttggcaaagcaagttcgcctgctggctgctgcgctggcagttccgtcccgagaccacgcgcgaggtgctcgatcccgcccgcgcacggcgctttaccgacctgcggatgatggtgccgcgccgcgcgccgtcgggctatcggttgcgccagtgctacggcgcgggcgacgcgccgctgcgcggcgaatggctcgagcgcaccgatgcgggcgcggggcgcgggccgggccgcacgctgctgtacttccacggcggcggctattacttctgttcgacgaagacccaccggccgctggtgttcggcctgacgaagcgcgcgggcgtgcgctcgttctcgctcgactaccggcttgcgcccgaaaaccgtttcccggccgcgctcgacgacgcgctggccgcgtaccggcagctgctggcgctcggcacgccgcccgagtcgatcgtgctcggcggcgattcggcgggcggcggcctcgcgctcgcgacgctcgttgcgctgcgcgatcgcggcgagccgctgccggccggcgcgatcctgttctcgccatggaccgacctggccgccaccggcgccacgctgcgcacgaacgacggcgccgatccgatgttcgcgggcgcggcgctgccgaaggccgcgaagctgtacctcggcgacgagccggggacgaatccgtacgcgtcgccgctctatgcggatttcgcgggcctgccgccgctgtatatccaggtcggcagcaccgaggtgctgctcgacgattcgcgccgcgtcgccgagaaggcgaaggccgccggggtggcggtggagatcgaggtgtggccggacatgccgcacgtgtggcagctgtacgcgccgatgatgccggaagcacgcgacgcgctcgaccgcgcggccgcgttcctgcgccgcgtcgcggtcgagcgcgcggttcagcgcgccggcgagacgtcgattgcctgataggcggccctgacggccgccgagccatacttgcgctcgagccggcggacggtgaagtggccgtgcgccatctgctggaagtggtcgatgaacagcgtattgacggtcgcgcctagcacggcgccgatcgccggaatcgacttcgcggccatctgctcggtcacctgcaccgagaaacgcgacgccaccgtctgcacgagcttgaacacggccgccgagctgtgcgcggcgatgcccttcgtcgtgatgtcggacgatgccttcgagattgcctgcgcgagcgcgccgcgcagcacgaaataaccgagatcggcgtcctcttcctgcttgtccgggttgccgcccatgccgagcacggccaggcattgcagctgcgtatcgaccgagcccaggtcttcaccctcgctgcgcgcgatgtcgcacacggagcggaagatcagcgtcgtcgtcaccggcagctcgaccggcagcgcgagaaaaccgaacgcgccgcccgcggcgccggtcgtcgcgaccgcgagcttgtgcagcaggttgctcggcttgtcgggctcggcgtccggcgcgggcggcttgccgagcgtgcgcagcgcgatgttcaggcacttgcgcagcgcgagctgcgtcgcgtcgttgatcttgccggtcgcgaaatccggcagccgggcgatcattttctcgaccggtgcgcccagcatgcccgtcagcttcatcgtcagcgacgggctttccagcacctgcttcgcgcgccacagcgcgtcccgatcgtcctgcgacagcatggtggcgggggattgaaatcggttccatctttctccttggcggtctgggccggtttgaccgtcgccagcctagattactcccgcatgctagaattttgaaattgtttgactcgtcaaaagttgcgccaacaaaaatggccgtccataccgccgcccaccattcgagcgggcaagtcctgccgttccgcgaatcgctgctggcgatgatcgggatctcgttcgtcaccatgctcgtcgcgctcgaccagaccgtcgtcggcaccgcgttgccgaccatcgtcgccgagcttcggggttcgacctgtacgcgtgggtcgcgacctcgtacctgctcagttccgtgatcacggtgccgatcttcggccggctcggcgactattacgggcgcaagccgttcgtcatcgtgtcgatcgtcgtgttcaccggcgcgtccgtgctgtgcgggatggcgaacgacatgctgatgctcgtgctcgcgcgcgggctgcagggatcggcggcggaatgctggtcggcaccgcgttcgcgtgcattcccgacctgttccccgattccgtcgtgcggttgcgctggcaggtgctgatgagctccgcgttcggcatcgcgaacgcggtcggcccgtcgctcggcggcgtgctgacccagtcgttcggctggcgctcggtgttctacgtgaacctgccgatcggcctgctgtcgctgctgttcgtgtggcgttacctgccgcacctgcgtcacgtcgagcacgatcgcaagatgcggctcgactggccgggcgcgctgctgatcgcgctgtcgctcggcgcgctgcagctgttcgtcgaatggctgccgaagtacggcgtcgcgagctgggcgtcgctgctgctcgtcgtcgcggtcgcggccggtttcggcctgtggcactgggagaagcgctgcgcgcagccgatcttgccgttcgacatgttcggcaaccgcgcgctgtcggcgctcttcgtgctggcgatcctcgccggcttctcgatgttctcgctgctgttctacgcgccgctgctgttccagggcggcttcgggatgtcgccgaaggaggcggggctcgtgatcacgccgctcgtcgtgttcatcacgatcggcagcatcatgaacggccgtgtcgtcacgcgcatccgcaatccgaatgcgatgctgcatgtcggcttcgtgctgttcgcgatctcctgcgcgggcgtcgtcgtgtcgacccacacgacgccgaaatggctgctgatggcgctgatggtcgcgggcggcatcgggctcggcttcgtgctgccgaacctcaccgtattcgcgcagcagacggccggccgcgaacacctcggcatcgccacggcgctgctgcagtcgctgcggatggtcggcgggatgatcggcaccgcgctgaccggcacgctcgtcaaccagatgtactcgggcggcgtgcgcgatgcgctgtcggccgatcacgcgatgcagtggcacgcgcagctcgccgatccgcagatcctgatcgatcgcgccgcgcagggcggccttgtcgcggagctgacccgtgccgggcataatggcgcgctgctgctggaagcggcccgcgaatcgctcgtcggcgcgattcacgtgggtgtcgcgatggcggccgtcgtcgccgtggtgtcggtgtggcagtgccgccgcgtgccgccgatcgcgctgcggcgcaagatcgaaccgcatgtcgcggccgattgaacgattgaacgagtagaactgagcgcatggaagaacaggaccgcgtcgcgatcttgcagcaattcggacggacgtatcgcgcgttcatgaccgcattcgagacgcacgtcgggcaaccgatgccgcgctggcgcatcatggtcgcgttgcacacgatgggcgggcattcgtcgcagaagaagctcgtcgaagtgctgcgcatcgatccgggcgcgctcacgcgtcagttgaaatcgctcgacgcgctcggctggatcgagcgcgaatccgacgcacgcgacaatcgcgtgaccaacgtgacgctgacggacgccggccgcgccgcgttcgacgcgtgcctgccgcgccgcaaggcgtttctcgaacagacgatggcgcaattgccggacgacgtgctgaatgcgctgtcgggcgcgctggcgatgctggagtcgcggatcgcggacgtcggctcgacgccgaccgcgcgttgaagcacggggcagggcggcgcaggtcggcgtgaatacgccgcgccgccccggcacttcatctcatctcgattccctgcgggttcaaagctcgatgcgcgtgcccagcagcgcgaggaactgcgcgagccaggccggatgcgcgggccacgcgggcgcggtgacgaacggcgcgtcggtcacggccgcgtcgaccgggatgtccgcatattcgccgcccgcgagcttcacctcgggcgcgcaggccgggtaggccgagatgcgcttgccgcggatcacgtcggcggccgcgagcagttgcgccgcgtggcagatcgcggcgatcggcttgccggcttcggcgaattcgcgcacgagcgagatcaccttcggatcgagtcgcaggtattcggggcacggccgcccgcgatcgcgagcgcgtcgtagcgcgaggcgtcgacgtcgtcgaatgccgcgttcagcgtgaactggtggccgggcttctcggtgtaggtctggtcgccttcgaaatcgtggatcgcggtcttgatcttgtcgcccgcgcgtttgcccgggcacactgcatcgacgtggtggccgacggcctgcagcgcctggaacggcaccatcgtttcgtagtcttcggcgaaatcgccggtcaggaacaggatcttcttcgcggccatggctttctccagtggagctgcgttgagggcccgccgcggatgacgaatgccatgcccgcccggggcccgaggacgaaagcgcagtgtactccggctgcttgaagcgcgcgtgacggccgccccgcgcgagcggcggggcggtgcgcgcgacctgcgtcagaagaaggtttcgacgacttccgtcacgcggaactgcggatcgagcacgagcacctggcgccacttgtcgaacgtcaggcacgggtgcgagatgtcgaacgcgaccatgtcgccgaccttcacgtccgcgcccggcgggatctgcaggtacgcgtgctgatccatcatccccgtgacggcccagccttcggcggcggcgacgtcgcgcggggcggtgtcgcggcccgggcggaagtggcgcgccggctccggcagcccgcgtcgaacgccgcgtcgcgcttgccgagcgcgacgatcgcacggtcggcctcgggcaccgactgcacgtaggcccacaattgcagcgcgggcagcagcccttcgcccatcgtgcgtgcgatcgggttgcgcgcgaacacgtcggtctgcgccttcttgtagatgccgacatcgtgcgtcaggtagcagcccggacgcagcacgacttcggcgaagcccgcgtcggacgccttcgcgaattcttccgcgaccacgtcgtaccacgccgaaccggcgccggacaggatcgccggcgtacgcgcgaagcgacccgcctcggccagttcgcgcgtgagcgcgaccgcatcctgcaggaacgtgcggatctcgccttcctccttcagcacgccttcgtagagttcgatgccggccagcttcagcgtgtccggatagcgcgcgatcgcggcgagcacggcctcgcgctgcgcggcatcgcgcacgcccgcgcggccgcccggcacgccgagctcgagcagcacgttcagcggcttcttcagtgcgccgaagaagcggccgagctggtcgacgctctccgcggaatcgacgaggcagaagaattcgaagtcgggatcggacagcagccccgcgatgatcgtcatgttctggcggccgaccagctggttcgcgagcagcacgcgccgcacgccgccgtgatacgcggcctgcgtctggtgcgcggtcgcgagcgtgatgccccacgcgccggcatcgagctggcggcggaagagttgcggcgccatcgtcgtcttgccgtgcggcgcaaacttgacgccgtacttctggacgaatgcctgcatccagttcaggttgtgttcgatgcgatcctcgtaaagcacggcggccggcaggctgacgtcttccgcgagcaggttccactcgaggcggcctgcgtcgccgagcggcacgctcgcgctcggcagattgccgaggcccttgccgaacggatcgatcgtcgcttcctgatagtttgtaactttcatgtcatcccgctccatcatcactatgcattgcactgaagttgacacgcagatggtacagaaagtagcatctgcgcggtgatgttatttagtaacatcgagcttcgcacccttttccgcagatgaatacgcccgccaatccgtccgctccgcacgcggccgagccctatccgccacaggccgccccgccggtcctcgacatcgtcgcgcggatcgccgaatgcgcacccgagctgcgcgaagccgagcgcaaggtcgccgcgttcatcctcgccgatctggcgcgcgccgcacatgcgagcatcggcgcgctcgcgcgcgacgcggaggtcagcgtcgcgacggtcacgcgtttcgcgaaggccgtcggctgccgcgacgtgcgcgaactgaaggtgctggtcgcgcaggcggcggccgtcggccagcgctttctcgtgccgtccgacgacgcgccggccgacgacacgagccccgcgtcgatggtctacgacgagatccgcgtggcgctcgcgcacaaccaccagttgctgcgcaatacgtcgttcgaggaagccgccgacctgctcgccggcgcgaagatgacctatgtgtacgggcagggcggcggctcgaccgcgctcgccgacgagctgcgtttccggctcgtgcgcttcggccggccggtcgcgagctaccaggacagcctgctgcagcggatggtggccgcgacgctgtcgcgcgacaccgtcgtcgtcgcgctgtcggtgagcgggcgcgtgcccgagctgctcgagagctgccggctcgcgaagcgctacggcgcgaagctgatcgcgatcaccgcgccggcctcgccgctcgcgaagctggccgaccacctgatcccggtcgtcgcgttcgaaaccgatttcatttacaagccgtcgacatcgcgctacgcgatgatgatggcgatcgacgtgctcgtcaccggagtcgcgttgcggctcggcgatgcgggccgggaatcgctgcgtcgcatcaagcacgcgctcgatgcgcaccgcggcggcggagaccgtcaaccggtaggagactgaccatgcattcgcatcccgaagccgccgatacgctgatcgtcggcgcgcagctttacgacggtaccggcgcgccgcccgtcacgcgcgacgtcgcgatccgcaacggcgtgatcgcggcgatcggcaacctgtcgaactggctcgccgagaccgtcgtcgatgcgaacggccgtgcgctcgcgccgggcttcgtcgacgtgcacacgcacgacgacacgcacgtgatccgcgcgccgcagatggtgccgaagatctcgcagggcgtgacgaccgtgatcgtcggcaactgcgggatcagcgcgtcgccggtgacgctcgcgggcgatccgcccgatccgatgaacctgctcggcgaacgcggcgcgttccagtacccgaccttcgccgactacgtcgcggccgtgaacgacgcgcgtccggccgtgaacgtcgcggcgctcgtcggccacacggcgctgcgcaacaaccagatggaccgcctcgaccgcgcggcgaccgacggcgagatcgccgggatgcgtgcgcagctcgaggaggcgctcgcgaacggcgcactcggcctgtcgtcgggcctcgcgtacggctccgcgttcgcggcgccgaccgaagaggtgatggcgctcgccgagccgctcgcgaacgccggcgcgttgtacacgacgcacatgcgcaccgaattcgacgcgatcctcgatgcaatggaagaggcgtaccaggtcggccgccatgcgcgcgtgccggtcgtgatctcgcacctgaagtgcgcgggcccgtcgaactgggggcgcagcaccgaagtgctggcgtcgctcgaaggcgcgcgccgctaccagccggtcggctgcgactgctatccgtacagccgcagctcgtcgacgctcgacctgaagcaggtgacgggcgacatcgacatcacgatcacctggtcggagccgcacccggaagtggcgggcaagctgctgaaggcgatcgcggccgactggggcgtgaccgagcaggaagccgcgcagcgcatccgcccggcgggcgccgtgtaccacaacatgtccgaggaggacgtgcgccggatcctgtcgcacccggcgacgatggtgggctccgacggcctgccgaacgatccgctgccgcacccgcggctgtggggcgcgtttccgcgcgtgctcggccactacgtgcgcgacaccaacctgctgccgctcgaggaggcgatccgcaagatgacgtcgctgtccgcgcgccgctacggcatcgcgcggcgcggcgaggtgcatgtgggctaccacgccgacctcgtgctgttcgacccggcgcgcgtgatcgacgccgcgacgttcgagaagccgcagcagcccgcgcacggaatcgacgccgtgtgggtgaacggcgtgctgacctacgaaaacggccagccgaccggcgagcgcgccggcggcttcgtcgcacgcggcgagcgtgtgccggcgagtgccgacgccgcgttctgaacgcggttgtcgttccgatctgccgcgcgcgccgtcgtcggcgcgcgcatccgcaaccgtgcgttgcatgggaccggcgccggcgctgaagcgtcgaggcggtcgacaaacaaggagtgaaacgatgaagcgatatggcgtaggcgaagcgaaggggacgggcggtcaggtgatgccgttcgcacgcgcggtcgaggccgacggctggctgtacgtgtcgggccagacgccgatggtgaacggcgaggtcgtcgaaggcgggatcgtcacgcagtcgaagcagacgatcgagaacgtgatcgcgatcctgaaggaagccggctacggcctcgagcacgtcgtgcgctgcggcgtgtggctcgacgacgcacgcgatttcgcgtcgttcaacaaggtgttcgtgtcgtacttcggcgagcatccgccggcacgcgcgtgcgtgcagtcgagcatggtcatcgactgcaaggtcgaggtcgactgcatcgcgtacaaggcgccggcgaagtaacgccgcaacggcgagccgctccagaacgggcccggcgcattcacgtgcgccgggcccgttttgtcgtgtgtcgcgcacggttcgattgttgcccggtgcgccacggcggcaaccgccgcaacgccacccgcccgttcatgtaatgtgccgcgtgattgtacggaggggaaatacatggaatgggctgcgctggtgccggagctgatctgctcggacctcgccggaagcgtgcgcttctatcgtgacgtgctgggattccggattcgcttcgaacgtccggaagacggcttcgcctatctggaaatcgggcgggctcagttgatgctcgagcagtacagcgcggagggctggctgaccggcccgctggagccgccgttcgggcgcgggatcaattttcagatcgaggtcgatgcgctcgatcccattctcgacaggatccgcgccgcgggcgtgccgctgttcgtcgagccgcgcacgtcctggtatcgggagggcgagatcgagcatggccagatcgagatgctggtgcaggatcctgacggatacctgctgcgcctggtggagattctgccggagcggccggtgagcgggtgatcgtcggtcgtccgcgcttttcccgcgcaatgaaaaacagcccggccggttgattccggtcgggctgttgtatttgggcggccgcgcgtcgccggcggcaaagggcaaactgcggcggccacccgccgccgtcactgccgcgcgttgcgcgcgttgtccggcatcggctggttgtagttcgtgcggaacgggttgatgtcgagcccgccgcggcgcgtatagcgtgcatacaccgcgagcttcaccggtttgcacgcgtgcaggatgtcgaggaagatccgctcgacgcactgctcgtgaaagcccgtgtggttgcggaacgagatgatgtagcgcagcaggcccgcgtggtcgatctgcggcccgacgtagtgaatctgcacgctgccccagtcgggctggccggtgaccgggcagttcgagcgcagcaggtcggacacgagcgtctcctcgaccggcgcttcgtcgacggccgccgacagcagcgacggatcgggttcgtacacgtcggtgtcgaggtcgagccggtcgagcgacagcccgtcgagttcgtccatttcgagcttgccgaaatcgtgcggcgacacgagctgcacggcgacgctcgccccgcacgcggccgacacgtcgcgcttcagcgtgtcgcgcaccgcgtcgatcgagtcgaatttcgtctgcgcgaacgagccgagatacagcttgaacgacttcgattcgacgatgttcggcgattcggccggcacgtagaaggtcgcaaccgcgatctgcggcttgccgcgcgcgttgagccaggacagctcgtatgcgttccagatgtcggtgccgaagaacggcagcgccgacgcgatgccgagctgctcgcgcgcgccggcgcgcgggatcgggaacagcagcgacgcgtcgtactgggccgcgtagacggtggccttgccgagcggggaatgttcgggattcatgcgtgacgcctttacgacaggaagaggcggtaagccgggttggcgctctcctcgacatacggatagccgagtgccgcgaggaagcgttcgaattcggcgcgatcggcctgcggtacctgcagcccgacgaggatcgagctgtagtccgcgccctggttgcggtaatggaacaggctgatgttccagtccggcgccatcgacgacaggaacttcatcagcgcgcccggccgttccgggaactcgaagcggaacaggcgctcgtcgagcgcgagcggcgaacggccgcccaccatgtagcggatgtgttccttcgacagctcgtcgtgcgtcaggtcgacggacttgaagccgtgcgattcgaagttcgcggcgatctcggccgattcgccgcggcgcttgatctgcacgccgacgaagatgtgcgcggcctgcgcatcggcgatccggtagttgaactcggtgacgttgcggtcgccgacgagcgagcagaaccgcttgaagctgccgcgttcctcggggatcgtgaccgcgaacacggcttcgcgcgcctcgcccacttccgcgcgctcggcgacgaagcgcatccggtcgaagttcatgttcgcgccggacgtgaccgcgacgagcgtctggttctcgatgccttcgcgttccgcgtagagcttcgcgcccgcgaccgcgagcgcgccggacggctcgagcacgctgcgcgtgtcctggaagacgtcctgatcgccgcgcacagcgcgtcggtgttcaccgtcaggacgccgtcgaggtattcgctgcagagccggaaggtttcctcgccgaccagcttcacggcggtaccgtccgcgaacaggccgacctcgctcagctcgacgcgcttgcccgcgtcgagcgactgcgccatcgcgcacgaatcctcggcctgcacgccgatcaccttgatctccggtcgcaccgccttcacgtaggccgcgacgccggacgcgagcccgccgccgccgatcggcacgaagaccgcgtggatcgggccctggtgctggcgcaggatctccatcgcgatcgtgccctggccggcgatcacgtacggatcgtcgaacggatggacgaacgtgaggccgcgctcctcttgcaccttgaccgcgtatgcgtatgcgtcgctgtacgactccccggcctggatcacctcgacgctcgggccgccgtgcgcgcgcaccgcatcgaccttcacctgcggcgtcgtgacgggcacgacgatcaccgccttgacgcccatccgggccgccgagaacgcgacaccctgcgcatggttgccggccgatgccgtaatcacgccgcgcgcgagcgcgtccgccggaatgtgcgccatcttgttgtatgcgccgcgcagcttgaacgagaacaccggctggttgtcctcgcgcttgaggtagacggcgttgcgcaaccgggcggacaggttgcgggcggattcgagttccgtctcgatcgcgacgtcgtagacgcgcgcggtgaggattttcttcaggtaatcgtgggatgccatgggcgctcgcgtgcagtgcggtagcagacggtaaaggatcaatgatagcgccaagggtccgcctgtacgcaagcggcatgccgggcgcacgcccgcggggccgtgcggacggtgcatcggcgacgttgcgcggcctctttaccggcttaaccgcgcagttaccgaccggacggacggcgaatggccgcgtgaaatcgcgccgagccaggcctggcgcggctcgcggcgatagccccacgacctgtccgacgtgtcacgcgtggcccgatcatgggttagaattccgttttgaatcaaggattcggaagatgcagaggcaccctcggatcgcaccgttgaagccgacgccgcgcgcagccagccccgcggcggaacggcatgcgcgccgcgcgcgatcgtgctgatgatcgagtgccgccaggccctgtcgccggccaggaggggcgaatctccgcccgctccggccccatgaaggacagccgcgcgcctggtaatagaacagatttcccaagattgcgcccacgcgcttgccgacgcccgtgcacggtgtatcggccctccgagtcgtccgaacatgaacgcaccacaagttttcgatccgcatggcgcggcagccgccgtcgccgccgaccccgcgccccggttgcgcgagattccctacaactacacgtccttctcggatcgcgagatcgtgatccgcctgctcggcgaagaggcgtggtcggtgcttgacgagctgcgcgccgagcgccgtacgggccgctcggcacggatgctgtatgaagtgctcggcgacatctgggtcgtgcgccgcaacccgtacctgcaggacgacctgctcgacaacccgaagcgccgcgcgctgctgatcgaggcgctgaaccaccggctgaccgaaatcggcaagcgccgcagcgcggatctcaccgagcaccgcgacgacgcgggccgcgaacgcgcatcgcgcgtcgagatgctcgaaaccgccgcgcagcgcgcggtcaacgagttcgccgacgaattcgagaagatggccgacctgcgccgccgcgcgaccaaggcgctcggccgctgcacgcagaaggacaacatccgtttcgacggactgtcgcgcgtgtcgcacgtgaccgacgcgaccgactggcgggtcgaatatccgttcgtcgtgctcacccccgataccgaagccgagatcgccggcctgatcaaggcctgcttcgagctcggcctgaccgtgatcccgcgcggcggcggcaccggctacacgggcggcgcggtgccgctcacgccgttctccgcggtgatcaacaccgagaagctcgaacagctcggcgcggtcgagctgaccgagctgccgggcgtcgcgcacaaggtgccgacgatcttctccggcgcgggcgtcgtcacgcgccgcgtgacggaagccgcggaagcggccggctatgtgttcgcggtcgatccgacctcgctcgacgcatcgtgcatcggcggcaacgtcgcgatgaacgcgggcggcaagaaggccgtgctgtggggctcgacaacctggcctggtggcggatggtcgacccggacggcaactggctcgaagtcacgcgccacgagcacaaccagggcaagatccacgacatcgcggtcgcgcgtttcgagctgaagtggttcgacggcgcatatgcgccgggcgagaagctgctgaagagcgagatgctcgagatcgagggccgccggttccgcaaggaaggcctcggcaaggacgtgaccgacaagttcctggccggcctgccgggcgtgcagaaggaaggctgcgacgggctcatcacgtccgcgcgctgggtgctgcacaagatgcccgcgcacacccgcaccgtctgcctggaattcttcggccaggcgcgcgaggcgatcccgagcatcgtcgagatcaaggactacctgttcgagacgtcgaagcagggcggcgcgatcctcgcgggcctcgagcacctcgacgagcgctacctgcgcgcggtcggctacgcgaccaagagcaagcgcaacgcatttcccaagatggtgctgatcggcgacatcgtcggcgatgacgccgacgcggtcgcgcacgcgacgtccgaagtgatccggatggcgaacggcaagagcggtgaaggcttcgtcgcgatcagcgcggaggcgcgcaagcgcttctggctcgaccgcagccgcacggccgcgatcgcgaagcacacgaacgcgttcaagatcaacgaagacgtcgtcatcccgttgaaccggatgggcgagtacaccgacggcatcgagcggatcaacatcgagctgtcgctgaagaacaagctgcagctggtcgacgcgctggaagcgtttttccgcggcggcaacctgccgctcggcaagaccgacgacgcgaacgagatcccgagcgccgaactgctcgaggatcgcgtccagcaggcactggagctgctcaagcgcgtgcgcgcgcggaattcgtgcgcgaccgcctcgaccagccgctgcgcgaggcgcagcactacctcgtgcaactcggttacgaggcgctcgccgagaagttcgccgatcgcgcggacgagcagccgggcgcgaccgtgttccacgtcacgcaggaccgcacggtccgcatctcgtggaagcaggagatccgcgcggagctgcgcgcgatcttcaacggcggcgcgttcaagcagatcctcgacgaagcgcaggcgatccacaagcaggtgctgcgcggccgcgtgttcgtcgcgctgcacatgcacgcgggcgacggcaacgtccacaccaacctgccggtcaactccgacaactacgagatgctgcaggacgcccacgcggcggtcgcgcgcatcatgacgctcgcgcgttcgctcgacggcgtgatttccggcgagcacggcatcggcatcacgaagctcgagttcctgaccgacgacgagatcgccgaattccgcgcgtacaagcagcgcgtcgacccgaacggccgtttcaacaagggcaagctgctcgaaggcgccgatctgcgcaacgcctatacgccgagcttcgggctgatgggatacgagtcgctgatcatgaagcagtccgatatcggcgcgattgccgattcggtgaaggactgcctgcgctgcggcaagtgcaagccggtgtgcgcgacgcacgtgccgcgcgcaaacctgctgtacagcccgcgtaacaagatcctcgcgacgtcgctgctggtcgaggcgttcctgtatgaggaacagacgcgccgcggcgtgtcgatcaagcactgggacgagttcaacgacgtggccgaccactgcacggtgtgccacaagtgcgcgacgccgtgcccggtgaagatcgatttcggcgacgtcacgatgaacatgcgcaacctgttgcgcaagatgggcaagaagaaattcaacgccggcaatgcggcgggcatgttcttcctgaacgcgaccaacccgcagacgatcaacgccgcgcgcagcgtgatgatgggcgtcggctacaaggtgcagcgcttcgcgaacgacatgctgaagaacgtcgtgaagaagcagacgcagcacccgccggcgacggtgggcaagccgcccgtcgtcgagcaggtgatccacttcgtcaacaagaagatgccgggcaacctgccgaagaagacggcgcgcgcgctgctcgacatcgaggacaacaagatcgtgccgatcatccgcaacccgaagtcgacgaccgtcgattcggaagcggtgttctacttcccgggctgcggctccgagcgtttgttctcgcaggtcggcctcgcgacgcaggcgatgctgtggaggccggcgtgcagaccgtgctgccgccgggctacctgtgctgcggttatccgcagcgcggctcgggccagtacgacaaggccgagaagatcgtcaccgacaaccgcgtgctgttccaccgggtcgcgaacacgctgaactacctcgatatcaagacggtggtcgtgtcgtgcggcacctgctacgaccagctcgccggctacgaattcgacaagatcttcccgggctgccggatcatcgacatccacgagttcctgctggagaaggggatgaagctcgacggcgtgacgggcacgcgctacatgtatcacgacccgtgccatacgccgatcaagacgatggacccggtgaagctcgtcaacgagctgatgggctcggagaaggacggctacaagatcgagaagaacgatcgttgctgcggtgagtcgggcacgctcgcggtcacgcgcccggacgtgtcgacgcaggtacgcttccgcaaggaagaggagatccgcaagggcgccgcgaagctgcgtgcgattcccgtggtggccggcgctgcgccggcgccagccgccgcggccgcgaacggcccggacgtgaagatcctgacgagctgcccgtcgtgcctgcagggcctgtcgcgctacagcgaggatgcgaacctcgaagccgactacatcgtggtcgaaatcgcgcgccaggtgctcggcgagaactggatggccgattatgtcgcacgcgcgaacaatggcgggatcgagcgcgtgctggtctaatgcgggcatgacgaccgcccgaccgggctggggatgagcgggcgccggcgcggcaatgccggcgcccgtccacatgggagcgacgatggaatgcgtgttttgccgtgaagacggcggcgaggtgctctggcaggacgatgcgctgcgcgtcgtcctcgcgacgggcgagcacgagtatccgggcttctgccgggtgatctggggcacgcacgtagcggaattctccgatctcggcgagcccgagcgggcccacctgatgcgcgtggtctacgcggtcgagcgggccgtgcgccgcgtgatgcagccgaacaaggtgaatctcgcgagcctcggcaacatggtgccgcacgtgcactggcacgtgatcccgcgcttttccaacgacgcccacttcccgcagcccgtctgggcgccgcgccagcgcagcgtgtccgaggcgctgctgcgcacgcgcgcggcgcaggcctcgctgctgcacaatgcggtgcgcgaggaaattcaacgcatgaccgattcgaggcagccatgagcggtttgacttccacgacgccgattccgtccggcgtcgtcgtgcacgcagtatcgcgcgtgctcgaattgcagtacccgaacggtgaaagctaccggattccgttcgagctgatgcgcgtgtattcgccgtcggccgaggtgcgcggccacgggcccggccaggagacgctgcagaccggcaagcgcgaggtgacgatcaccgcgctcgagggcgttggcaactacgcgctgcagccgacgttttccgacggtcattcgaccggcatctactcgtgggacctgctgtacgagctggccacgcagcaggacgcgctgtggcgcgactatttcgacaaactgaaggcggcgggtgtcgagcgtgacgccccgatgcaggcggcctccgcgtcgcacggccactgccactgaaattcgacggcgcccgctcggcgccgtcttgccatttactgaggatcaacgcgatgagcaaaacccacttcggcttcgaaagcgtcgaggaaaacgaaaaagcgaagaaagtggcgggtgtgttccattcggtcgcgagcaactacgatctgatgaacgacctgatgtcggcgggcatgcaccgcgcgtggaaggcgttcacgatcgcgcaggcgaacgtgcgtcccggcttcaaggtgctcgacatcgcggccggcaccggcgacctgaccaaggcgttcgcgaaggcagccgggccgacgggcgaggtctggcacacggacatcaacgaatcgatgctgcgcgtcggtcgcgaccggctgctcgacaagggcatcgtgacgccgtcgctgctgtgcgacgcggagaaaatccctttccggacaactacttcgatctggtcacggtcgcgttcgggctgcgcaacatgacgcacaaggatgccgcgctggcggagatgcgccgcgtgacgaagccgggcggccgcgtgatggtgctggaattctcgaaagtctgggatccgctgaaaaaggcgtacgatctgtattctttcaaagtattaccgtggcttggcgacaagttcgcgaaagatgctgaaagttaccggtatcttgctgaatctatccggatgcaccccgatcaggacacactgaagacgatgatggaacaagcgggcctcgatgccgtcaaatattacaatttgtcaggtggcgtggtagctttacacatgggagccaagtactaaggggctctttccatacatttgtcttacatctggagaagctgatgtccgaaacgcgttcgttgttcaaccgtagcaagccgtcgaagccgtgggctcgacgagtcggcacactgctgatggtcggcctgctcacggccggcacgttcgcatcgctcgacgctgaagccaagcgcatgggcggcgggcgcagcatcggccgccagaattccaccgtcacgcagcgccaggccacgccgcctgcgcagcagccgatgcagcaggccgcgccgtcgcaggcgcagcgtgcgaacccggccgcgcccgcgccggccgcgcagcccaaccgctcgcgctggctcgggccgatcgccggcctcgcggccggtctcggcatcgcggcgctgctgtcgcacttcggcctgggcggcgcattcgcgagcatgatggcgaacgtcatcgtgatcgcgctgctcgcgatggtcggcatctggctgatccgcaagttcatgaaccgccgtcgtccgcaggagccggcatactcggtcggcggctcggcgtcgtcgtcgggcggctactcgcagagcccgtcgttccagcagggcggcaccggcagcaactatgcgggtagcggcagcagctacgcgaacgaagcgcaaggcgtgttcggcggcggtgccgcgggcgcaggcgcggcagcggcggcggcagcaccgctccaggtgccggccggcttcgacaccgaagcgttcctgcgcagctcgaaggtttatttcgtgcgcctgcaggctgcgtgggaccagggcaacctggccgacatccgcgagttcacgacgcccgaaatgttcgccgagatcaagatcgacctcgattcgcgcggcaacgagtcgaaccagaccgacgtcgtgcagctcgacgcggaactggtcgcgatcgaggatcgcggcatcgagcagtcggcgagcgtgcgtttccatgggctgatccgcgaatcggcgaatgcgtcggccgcgccgttcgacgaggtgtggaacctgtcgaagtcgggcagtcagggctggctgctcgcgggcatccagcagatcaacacgcactgagcgtgtccggcggccacgccgccggacaccgggcaacggccgccgcactgcgaccgcttgccgcccgggtgtgcggtcaggcacggcctgccgacgatccgacgttacaatagaaacccgcgtgggcgcccggcctgcgcgggtttttctttcccagcccgatgacctttgccgccaagccttttgctgctgctgtcaatcacctgctcgcccgcgaatcgtgggcgcgcgaccgcctgattccgtatgcgggcaagactgcccggatcgacgtgcctcccgttacgctcacgctgctggtgcagcccgacggctatctgtcggccgtcgacgcgcacgatgcgcaacaggtcgacgtgtcgatcgcgctcgcgggcgacacggtcgccgcgttcctgcagggcggccaggcggccgtgatgaagcacgtgaagatcgagggcgatgcggagttcgcgacgcagatcgcgaagctggccgagcacctgcgctgggaacctgaagaagatctcgcgaagctggtcggcgacgcggcggcataccggatcgcgacggtcgtgcgcgacgccggtgcgcgcgcgcgacgtaccggccgcaacgtgctcgattccgttgccgaatactggctcgacgagaacccgcaagtcgtccggcgcgcgtcgctcggcggcttcgacgccgaactggcgcgcgcacgcgatgcgctcgcgcgggtcgaaaagcgggtcgagcgactcgaacaaaaatcggcgcgcgcacgggttccggcccgcgcggcgcgcactgagggccgcagggcatgcgcattttccgtttcatcaagattgtctacaccgtcatccgctttggtctcgacgaagtgatgctgtcccggatcgacgaccggcgcgtgaagctgctgctgcggatcacgacgatcggtcgccgttattccgatccgccggcggtgcggctgcgccatgcgctcgaaagcctcggcccgatcttcgtcaagttcggccaggtgctgtcgacgcgccgcgacctgctgtcggtcgatttcgcgaacgaactcgcgaagctgcaggatcaggtgccgccgttcgattcggcggtcgcgatcgggatcatcgagaagtcgctcggtgcgccggtcgacgagctgttcgacgaattcgagcgcgaaccggtcgcgagcgcgtcgatcgcgcaggtgcatttcgcgaagctcaagcagggccagcacgcgggcaaggccgtcgcggtcaaggtgctgcgcccgaacatgctgtccgtgatcgattccgacctcgcgctgatgcgcgacatcgcgatctggaccgagcgcatgtgggccgacggccggcgcctgaagccgcgcgaggtcgttgccgagttcgacaagtacctgcacgacgaactcgacctgatgcgcgaggccgccaacggcagccagctgcgccgcaacttcgcgggcctcgacctgctgctcgtgcccgagatgttctgggatttctcgacgtcgcaggtgctcgtgatggagcgcatgaccggcgtgccgatcagccaggtcgagacgctgcgttcggccggtgtcgacatcaagaagcttgcgcgcgaaggcgtcgagatcttcttcacgcaggtgttccgcgacggcttcttccatgcggacatgcacccgggcaacatccaggtgagcctcgatccgaacaccttcggccgctacgtcgcgctcgatttcgggatcgtcggcgcgctgtccgatttcgacaagaactacctcgcgcagaacttcctggcgttcttcaagcgcgactaccaccgcgtcgcgacgctccatctcgaatcgggctgggtgccgcccgagacgcgcgtcgaggagctcgaaagcgcgatccgtgcggtgtgcgagccgtatttcgatcgcgcgctgaaggacatctcgctcggtcaggtgctgatgcgcctgttctcgacgtcgcgccgcttcaacgtcgagatccagccgcagctcgtgctgctgcagaagacgatgctgaacgtcgagggctcggccgctcgctcgaccccgagctcgacctgtggaagaccgcgaagccgtacctcgagcgctggatgaccgagcagatcggcctgcgcggctggtacgagcgcttcaaggtcgaagcgccgcagtggagcaagacgctgccgcaactgccgcgcctgatccatcatgcgatggcggcgcgccacgacgcgccgcgcgcggcgagcgaggacctgatgcgccagattctcgtcgagcagaagcggacgaaccggctgctgcaggcgttgctgatcttcggtctcgccgtcggcgtcggggcgctcgtcgcgcgcgtgctgctcgcgctcgcgtacggcacatgaccgaaaggagcagggcgatgtccgatccgaagcaaccggctacaccggcagccgccgatttcacgacgcgcgatcccggcaatgcatcgttctgggacgaacgtttcgcgcgtggcgtgacgccgtgggaattcggtggcgtgcccgacgggtttcgcgtgttcgcgcaccggctcgagccgtgcgcggtgctgattccaggctgcggcagtgcgcaggaggccgggtggctcgcgcaggccggctggcctgtgcgtgcgatcgatttctccgcgcaggcagtggcagttgcgaaagcgcagctcggcgcgcacgcggaagtcgtcgagcaggccgatttcttttcgtaccggccgccgttcgacgtgcagtgggtgtacgagcgcgcgttcctgtgcgcgctgccgccggccatgcgcgccggctacgcggcacgcatggccgagctgctgcccgtggacggattgctggcaggttatttcttcctgatggcgaaaccgaaggggccgccgttcggaatcgagcgtgccgaactcgatgcgctgctcacgccgcacttcgaactgatcgaggatttgcccgtgaccgattcgctgcccgtgttcgaaggtcacgagcgctggctgacgtggcgccgccgctgatgcgcgggtgtcgcggccattgccggagcgcggcggggtttcagctataattcaaggttttgcaagccgtttccagtttccgcgggaaaaatatcatgccgatctacgcctatcgatgcgaagcgtgtggcttcgcgaaggacgtgctccagaagatgagcgatgcgccgctgtcgcagtgtccggaatgcgggaaggatgcatttcgcaagcaggtcactgcggcgggcttccagctgaagggttcgggttggtacgtcaccgatttccgcggcggttcgggcggcaccagcgcgccggcgacggcgtcgggcgacgcagcgccggccgcaccggcggaagccgcgcccgccgcggccgcgccggcggcatcgagcagttccgaaagcacgacgacgagcgctgcgcctgccccggcagccgcgcccgccgccagcagttgaccgtcgcggcccggccgggctgcgaccaacccgccgccggcgcggttcattgacggcagatgatgaaaaagacgaccctgaaatcggtgtttctgaccggcctgctggttctcgtcccgctcgcgatcacgctgtgggtgctcggtctcatcatcggcacgatggaccagacactgctgctgctgcccgaatcgtggcagcccgagcggatgctcggcttccacttgccggggatcggcgcggtgctgacgctcgcgttcatcttcgtcgtcgggctggccacgcggaacttcatcggccagaagctcgtcacgtggtggaacgccgtggtgcgtcacatcccggtcgtcgggccgatctacacgagcgtcaagcaggtgtcggacacgctgctgtcgagcagcggcaacgcgttccgcaaggcgctgctgatcgaatacccgcgtcgcggctcgtatacgatcgcgtttctgaccggcacgccgggcggcgacgtgctcaatcatctgacggaagaatacgtgagcgtctatattccgacgacgccgaacccgacgtcgggcttcttcctgatgctgccgaagagcgaagtcatcgaactcgacatgtcggtcgatgccgcgctcaagtacatcgtctcgatgggcgtggtggcgccccggcgccggttccggcgcctgcgcgccgccccgtcgagccgccgctgtaagtaaagaatcatcgcccgggccgcgcgttgcggcgcccgttgatcaaaccgaacgaaagcaaacatcatgtcgatgcgtactgaatactgcggtctcgtgaccgaacacctgctgggccaaaccgtgtcgctgtgcggctgggtgcagcgccgccgcgatcacggcggtgtgatcttcatcgacctgcgcgatcgtgaaggcctcgtgcaggtggtgtgcgacccggatcgcgcggaaatgttcgcgaccgccgaaggcgtgcgcaacgagttctgcgtgcagatcaagggcctcgtgcgcaaccgtccggacggtacggtcaacgccggcctgaagagcggcaagatcgaagtgctgtgtcacgaactgaacgtgctgaacgcgtcggtcacgccgccgttccagctcgacgacgacaacctgtcggaaacgacgcgcctcacgcaccgcgtgctcgacctgcgccgcccgcagatgcagcacaacctgcgcctgcgctaccgcgtcgcgatcgaagcgcgcaagtacctcgacgagcagggcttcatcgacatcgaaacgccgatgctgacgaagagcacgccggaaggcgcacgcgactacctcgtgccgtcgcgcgtgaacgcgggccagttcttcgcgcttccgcagtcgccgcagctgttcaagcagctgctgatggtcgcgaacttcgaccgttactaccagatcaccaagtgcttccgcgacgaagacctccgtgccgaccgtcagccggaattcacgcagatcgactgcgaaacgtcgttcctcggcgagcaggaaatccgtgacctgttcgaagacatgatccgtcacatcttcaagacgacgatcgacgtcgaactcgacgcgaaattcccggtgatgccgtactcggaagcgatggcgcgtttcggttcggacaagccggacctgcgcgtgcagctcgaattcaccgagctgaccgacgcgatgaaggacgtcgacttcaaggtgttcagcacgccggccaacgcgaaggacggccgtgtcgcggagctgcgcgtgccgaagggcggcgagctgtcgcgcggcgacatcgacggctacaccgaattcgtgcgcatctacggcgcgaagggcctcgcctggatcaaggtcaacgagaaggcgaagggccgtgacggcctgcagagcccgatcgtcaagaacctgcacgacgcgtcgatcgcggcgatcctcgagcgcaccggcgctgaagacggcgacatcatcttcttcgcggccgaccgcgcgaaggtcgtcaacgacagcctcggcgcgctgcgcctgaagatcggccattcggaattcggcaaggcgaacggtctggtccaggccggctggaagccgctgtgggtcgtcgacttcccgatgttcgaatacgacgacgaagatgcgcgctacgtcgctgcgcaccacccgttcacgagcccgaaggacgagcacctcgagtacctcgagaccgacccgggccgctgcctcgcgaaggcctacgacatggtgctgaacggctgggaaatcggcggcggctcggtgcgtatctatcaggaggaagtgcagagcaaggtgttccgtgcgctgaagatcggcgcggaagaggctcagctcaagttcggcttcctgctggatgcactgcagtacggcgcgccgccgcacggcggtatcgcgttcggtctcgaccgcatcgtcacgatgatggccggcgccgattcgatccgcgacgtgatcgcgttcccgaagacgcaacgtgcgcaggatctgctcacgcaggcaccgagcccggtcgacgagcgtcagctgcgcgaactgcacatccgcctgcgtcagccggaacagccgaaggcgtaacgcgcttcgcatccggtcgtgtgtgcgttcgcgcgcacacgacgctcatgaaaaaggcgcagcgatgcgcctttttcgtttttgcggtacagtcgcagcacttgccgcccgttcggagcctgtgcccggcgcgcggccccgtgctgcatgaaacaaagatgacgaagccgccgaaaatccccgaatccgttcttgtcgtgatctacacgcccgacctcgatgtgctcgtgatcaagcgtgccgaccagcccgatttctggcaatcggtgaccggctcgaaggacgcgctcgacgagccgctcgcggtcaccgccgcgcgcgaagtggccgaggaaaccggcattgcggtcggcaccgcgaatgtgccggccagcgcgctcgtcgactggcgccaccggatcgagtacacgatctatccgcaatacctgcaccgctatgcgccgggcgtcacgcgcaacaccgaacactggttcggcctgtgcgtgccgcatcgcgtcgacgtgacgctgtcgccgcgcgagcacgtcgaccatgcgtggctgccgttccgcgaggcggccgcgcgctgcttctcgccgtcgaatgccgaggcgatcctgcaattgcccgcgcgcgtggcactctcgcgcgcgccgcacggctcgtccgcatgacggcggaagcccgcagcgcttcgcgcaattgcggcagatgttcctgcaggaacgcggttccgcgtcgcggctcgcctttacgtcgggcaacaccgtgcggctgtgcgagggcggcggcgcattcttccgggcactgatcgagcggatcgatgccgcccgcgagcaggtgatgctcgaaacctacatcttctgcgacgacgcggccggccggccggtgtcggacgcgctgatccgcgcggcgcagcgcggcgtgcgcgtgcgcgtgatcaccgacggcatcggcaccgcgcgcctgccgctgttcgacacgtgggtggcggccggcgtcgagcactgcatctacaaccgtttcctgttcggccgcttcggcttctcgcgcacgcatcgcaagctcgcggtgatcgatcacgcggttgcattctgcggcggcatcaatatcgtcgacgactacgcgcagggcggcgcgacgctgccgtttccgcgctgggatttcgcggtcgagatggcggggcccgcggtgtcggacgtgcgcgccgcgttcgaattgcagtggcaccggatcatgttcggccacaagccgtatgcgcaatatgcagccgggctgcatggcgggaagcgttccccgacatgttccggcgctggatgcgcagccatcgctggatcaaggccggcgcgctgcgggtcgtgacggagccgagcgtcgcgttcgtcgcgcgcgacaacgtcgtgaaccgtcgcgcgatcgagaaggcgtatctcgcggcgatcggccaggcacgccagcggatcctgctggccaatccgtacttcatgccggggcgcaagctgcgccgtgcgctggcggcgccgcgcggcgcggcgtcgacgtgcggatcctgatcggccgcaaggaattcgcggcactcgatacggccgtgccgttcctgtatcacgcgctgctgcgcgcgggcgtgcgcgtggccgagtacgacaagacgatgctgcacggcaaggtggccgtgatcgacgacaactgggcgacggtcggttcgtcgaatctggacgcgctgagcctgatgttgaacaatgaggcgaatgtcgtgctggtgcgctacgatgctgtcacgaacgaactgcgcgacgcgatcgcggccgcgtttgccgacggccgggaaatcgaccccgcccgattcgccgcgcgcccgcgcatcgagcgcatgctgaactggctcgcctatacggcgtatcgtgtcgtgatgaaggcgctgacggtcggtggttacgactgacgcagactaagcgttcgcttcaaaatctgtccgcacgttcgtgcggaaaagccgctccggtcccgccggaatcgcgcaaaatagcggctcggttagacaccggtttctaataatttccttgtttcgcgagcggccgcactcaataatagtacggccgttcgattttattcgaaccccgaacggttacagaaatagctatgcgaaaaggcgaacagacgcgtgccgcgatacttgaagctgctttggacctcgccagccgtgacgggctggaggggctgacgatcggcctgctggccgagcgcatgcagatgagcaagagcggcgtgttcgcgcacttcggatcgcgcgaggacctgcaggtcgaggtcgtccgcgagtatcaccatcgtttcgaaaacgaggtgttctttccgagcctgcgcgagccgcgaggcttgccgcgccttcgggcgatgctggcccgctggacggagaagcgcatccaggaggtgacgaccggatgcatctacatcagcggggccgtcgagtacgacgaccggcctgacagccccgtgcgcgagcagttgatcgcgagcgtgacggcctggcgtgccgcgatgctgcgggccatttcgcaggcgaaggaagaaggccatctgcgtgcggataccgatccggacctgatgctcttcgagttgtacagcttcacgctcggcctgcatcacgacgcacgtttcctgcattcccggatgccgtgcgcctcacgtgggccgcgctggaaaagacgattgtttcgtatcagagcgagagccgttagcggcgcgtgatccgcccgccaggagctcgagccgttttgcccacctttggagagagtcatgggacagtacgccgcgccgctgcgcgacatgcaattcgtgttgcacgagcttctgaacgtcgaagccgaagtcaagcaaatgcccaagcatgcggacctcgacgccgacacgatcaaccaggtcctcgaggaagcgggcaagttctgctccgaggtactgttcccgctgaaccaggtcggcgaccgcgaaggctgcacgtatgaaggcgacggcgtcgtgaagaccccgaccggcttcaaggaggcctaccagcaatacgtcgaggccggctggccggcgctcggctgcgatccggactacggcggccagggcctgcccgcgttcgtgaacaacgcgctctacgaaatgctgaactcggcgaaccaggcatggacgatgtatccgggcctgtcgcacggcgcgtacgaatgcctgcacgcgcacggcgcgccggaactccagaagcaatacctgccgaagctcgtgtcgggcgaatggacgggcacgatgtgcctgaccgagccgcactgcggcaccgacctcggcatcctgcgcaccaaggccgaaccgaacggcgacggctcgtactcgatcagcggcacgaagatcttcatctcgagcggcgagcacgacatgtcgaagaacatcatccacctcgtgctcgcgcgcctgccggacgcgccgcagggcacgaaggggatctcgctgttcatcgtgccgaagttcattccggacgcgtcgggcgagccgggcgagcgcaacggcatcaagtgcggctcgatcgagcacaagatgggcatccacggcaactcgacgtgcgtgatgaacctcgacggcgcgaagggctggatggtcggcgagccgaacaagggcttgaacgcgatgttcgtgatgatgaatgccgcgcgtctcggcgtcggcatgcaaggcctcggcctcacggaagtcgcgtaccagaactcgctcacgtacgcgaaggaacgcctgcagatgcgttcgctgacgggcccgaaggcaccggacaagccggccgacccgatcatcgtgcacccggacgtgcgtcgcatgctgctcacgcagaaggcctacgcggaaggcgcacgcgcgttcacgtactggtccgcgctgcagatcgacaaggagctgtcgcacgccgacgaagcggtgcgcaaggaagcggccgatctcgtcgcgctgctcacgccgatcatcaaggcgttcctgaccgacaacgcgttcgagtcgaccaaccacgcgatgcagatctacggcggccacggcttcatctccgagtggggcatggagcagtacgtgcgcgacgcgcggatcaacatgatctacgaaggcacgaactcgatccagtcgctcgacctgctgggccgcaaggtgctcggcgacatgggcgcgaagctgaagaagttcggcaagctcgtgacggaattcgcggaagccgaaggcgtgaagccggaaatggccgagttcatcaacccgctcgccgacatcggcgacaaggtgcagaagctgacgatggaaatcggcatgaaggcgatgcagaaccccgacgaagtcggtgccgccgccgtgccgtacctgcgcaccgtcggccacctggtgttctcgtacttctgggcgcgcatggcacgcctcgccctcgacaaggaagcgtcgggcgatccgttctacaagtcgaagctcgcgacggcacgcttctacttcgcgcgcctgttgcccgagacggcatcgacgatccgcgccgcgcgccggttcgaagacgctgatggaagtcgacgaatcgctgttctgacgcgagtccgggcggggcgcgaggcgcgccgcccggatgcatcggttcctggtactcacttctccgtgcagccccaacctccgcgctgcacgacactatccggagacatcccgtgagcaatttcctgattcgcaaggtcgccgtgctgggcgccggcgtgatgggcgcgcagatcgccgcgcacctcatcaacgcgcgtgccggtgctgctgttcgacctgccggccaaggaaggcccgaaaaacgcgatcgcgctgaaggcgatcgagaacctgaagaagctgtcgccagcgccgttcggcgtgaaggacgacgcgaaatacctcgaagccgcgaactacgaagacgacatcgcgaagctcgccgagtgcgacgtcgtgatcgaagcgatcgccgagcggatggactggaagcacgacctgtacaagaaggtcgcgccgcacatcgcgccgaacgcgatcttcgcgaccaacacgtcgggcctgtcgatcacgaagctgtccgaaggtttctcggacgagctgaagtcgcgcttctgcggcgtgcacttcttcaacccgccgcgctacatgcacctcgtcgagctgatcccgaccgcgcatacgcgcccggagatcctcgaccagctcgaaaccttcctgacgagcatcgtcggcaagggcgtcgtgcgcgcgaaggacacgccgaacttcatcgcgaaccgcgtcggcatcttctcgatcctcgcggtgatcaccgaggccgcgaagttcggcctgcgcttcgacgaagtcgacgacctgacgggcagtcgcctcggccgcgcgaagtcggcgacgttccgcaccgcggacgtggtcggcctcgacacgatggcgcacgtgatcaagacgatgcaggacaacctcgccgacgatccgttcttcccggtctaccagacgcccgccgtgctcgccgaactggtgaagcagggcgcgctcggccagaagacgggcggcggtttctacaagaaggaaggcaaggcgatcaaggtgctcgacgcgaagacgggcacctatgtcgactcgggcgcgaaggctgacgaaaccgtcggccgcatcctgaagcgcccgccggcggaacgcctgaagctgctgcgcgagacggaccatccgcacgcgcagttcctgtggtcgatcttccgcgacgtgttccactacatcggcgtgcatctcgaatcgatcgccgacaacgcgcgcgacgtcgacctcgcgatccgctggggcttcggctggaacgaaggcccgttcgaaggctggcaggccgccggctggaagcaggtcgccgagtgggtgcaggaagacatcgcggccggcaaggcgctcgcgaacgtgccgctgccgtcgtgggtgctcgaaggcgcggttgccgagaagggcggcgtgcacacggccgaaggctcgtgggctccggctgcgaagcgcttcgtgccgcgttcggacctcgcggtctacgacaagcaggtattccgcgcgccgctgctcggcgaagcgggcgccgatccgaagacgtacggcaagacgctgttcgagaccgacgcggtgcgcgcatgggtcgacgatcgtgcgggtgaagacgacgtcgtgatcgtgtcgttcaagtcgaagatgaacacgatcggaccgagcgtgatcgacggcctcgtgcaggcgatcgaactcgcggagaaggactacaagggcgtggtgatctggcagccgacgtcgctgaagctcggcacgccgggcggcccgttctcggccggcgcgaacctcgaagaggcgatgcccgcgttcatgatgggcggcgcgaaggggatcgagccgttcgtgaagaagttccaggaaggcatgctgcgcgtgaagtacgcgaacgtgccggtcgtcgcggccgtgtcgggcatcgcgctcggcggcgggtgcgagctgatgctgcacagcgcgaagcgcgtcgttcacgtcgagagctacatcggcctcgtcgaagtgggtgtcggcctcgtgccggcgggcggcggcctgaaggaagcggcgctgcgcgcagcggacgccgcgacggccgcgaacgcgaccaccgacatcctgaagttcgtcacgaagtcgttcgagaacgcggcgatggcgaaggtctcggcctccgcgcacgatgcacgtgcgatgggctacgtgaagccgtccgacacgatcgtcttcaacgtgttcgaactgctcgacaccgcgaagaaggaagcgcgtgcgctggccgccaccggctaccgcgcaccgctgcgtgcgaaggacgtgccggtcgcgggccgctcggcgatcgcgacgatcaaggcatcgctcgtcaacatgcgcgacggccgcttcatcagcgaccacgactacctgatcgcgagccgcatcgccgaagccgtgtgcggcggcgacgtcgaagccggcagcctcgtcgacgagcagtggctgctcgcgctggagcgccgcgcgttcgtcgagctgctcggcacgcagaagacgcaggaacggatcatgggcatgttgcagaccggcaagccggtgcgtaactgagcgagcgataaggcaaggagtctcaaatgagcaaacaattgcaagacgcatacatcgtcgccgccagccgcacgccgatcggcaaggctccgcgcggtgtcttcaagaacacgcgcccggacgagctgctggtccacgcgatcaagtcggcggttgcgcaggtgccgggcttcgacacgaagctgatcgaggacgcgatcatcggctgcgcgattccggaagccgaacagggcctgaacgtcgcgcggatgggcgcgctgctcgcgggcctgccgcagacggtcggcggcgtgacggtcaaccgcttctgcgcgtcgggcatcacggcgctcgcgatggcggccgaccgcatccgcgtcggcgaatcggacgcgatcttcgcgggcggctgcgaatcgatgagcatggtgccgatgatgggcaacaagccgtcgatgtcgccgcacatcttcgatcgcaatgaagacttcggcatcgcatacgggatgggcctgacggccgagcgcgtcgccgagcagtggaaggtgagccgcgaagaccaggacgcgttctcggtcgaatcgcaccgcaaggcgcttgccgcgcagcaggccggcgagttcaacgacgagatcgccgcgtacacgatcaccgagcgtttcccgaacctcgcgaccggcgaagtcgacgtgaagacgcgcgagatcaagctcgacgaaggtccgcgcgcggacacgtcgctcgaaggcctcgcgaagctgcgcacggtattcgcgaacaagggctcggtcacggccggcaacagctcgcagacgtcggacggcgcgggtgcgctgctcgtcgtgtcggagaaggtgctgaaggaattcaacctgacgccgctcgcgcgcttcgtgagcttcgcggtacgcggcgtgccgccggaaatcatgggtatcggcccgaaggaagcgattccggccgcgctgaaggctgccggcctgaagcaggacgatctcgactggatcgagctgaacgaagcgttcgccgcgcaatcgctggcggtgatgcgcgatctcggcctcgacccgtcgaaggtcaacccgatgggcggcgcgatcgcactcggccacccgctcggcgcgaccggcgcgatccgcgcggcgaccgtcgtgcacggcctgcgccgccgtaacctgaagtacgggatggtcacgatgtgcgtcggcaccggcatgggtgccgcgggcatcatcgaacgcctgtaagcaggacacgacgcaaagcgacgacggtgcgcgggccacaagcttgcgcaccgtttttcgttccggtagaggaaagtcaaaggagacggttgtggctgaaattcaagtggaacgcgccgaaggcgtgatgacgatcacgatctcgcgcccggcgaagaagaacgcgctgacggcggcgatgtaccagacgatggccgatgcgctcgccgacgcgcaggaagacaaggcgatccgcgtgatcctgctgcgcggcagcgacggcaatttcaccgcggggaacgatctcgaggatttcatgaaggcgccgccgaaggacgacaccgctccggtgttccagttccttgcgcgaatcagcaccgcgagcaagccgatcgtggccgccgtgccgggcctcgcgatcggcgtcggcgtgacgatgctgctgcactgcgatctggtgtacgcagccgacaccgcgacgttctcgctgccgttcgcgcagctcggcctgtgcccggaagccgcgtcgagcgtgctgctgccgcgcctggccggccatcaggtcgccgccgagaagctgctgctcggcgaggcgttcgacgcgctggaagcgcaccggatcggcatcgtcaaccgcgtgctgccggcggccgagctcgacgcgttcgcggcgaagcaggcggcgaagctcgcggcgctgccggcggcgtcgctgcgcgtgacgaaggcgctgctgaaggatacgggtggtgtggcgacgtccgcgcggatggccgaggaggcgggccacttcgccgcgatgctgcgcgcgcccgaagcgcgcgaggcgatgacggcgttcttcgagaagcgcaagccggatttccgtcagttcgactgacggagcaggccgcgccggcgatggctcgccggcgcgccgccgcgaacgcgatcaggccgtgccgtagtcgacgtggccggtttcgcggcagaagctgacgagccgcaagccggccgcttttgcgatttcgatcgcgagcgacgacggcgcggagatcgtcgccaccatcgggatgccgacccgtgcggccttgcgcacgagctcgtagctcgcgcggctcgacaggaacacgaagccgtcggtcgcgtcggcgcgcgacagcacgagcgagccgatcagcttgtcgagcgcgttgtggcggccgacgtcctcgaacgccatccggatcgcgcctgttgcgtcgcaccacgcggccgcgtggaggccgcccgtgagccgcgtgagcgcctgatgcgccggcagcgcctgcgccgcgcgcgtcagcgcgtcgggggcgaggcgcgcgagaaagcccgtatcgggcacgcgctcgggcgcgaggtcgagcaggtcgatgctttcgatcccgcatacgccgcagccggtgcgccccgcgagcgcgcggcgccggtccttcagcgcggcgaacgcctgctggacgacctccaggtggacttctgcatgcggcagcggggcgtgggcgtgcaggatcacctcgatgtccttgatgtcgctgccgcgtgcgacgatcccttccgagatcgcgaaaccgaccgcgaacgcttcgaggtcgcacggcgtacacatcatcaccgcgtgcgagatgccgttgaagacgagggcgacgggccattcctggcccacgtagtcgtgcgcggtctcgacggcgccgccgcgcgtgcggcgtacggacagttcgatcgcgccgcgcggttcgtcgcgcatttcaccggattcggtcggattcacgagcactcccgttgattcggcgcgcgggcggcggcattcgtatccgccgcccgcacgcagaggttctaaaataccccaggcaagccggccgcgccggcatccgccacatcaggtaacgatcatgggactcagcgacgctccactgctattcgccttcgaacacgaatcgtcggaaaacttcacgtacatcccgatgatcgtgcgtttcaatctcgaccgtttcggtctgcggatttcgctggaacagtggcaactgctgccgctcgaggaccgcaagctgctcgcacgctttccggccgacgacgacaccgcgatcgagcccaacttcgatcacgcgctgttcgaaatgctgcgtacgcacgcggatctggagccctcgtggttccagccggacgagcagccggcctggcgcgccaccgacatcgtgccggagtcgctcgtgcagcagagcgcgctggccggcctgacggcgcccgggctcgcgcagtggcagcggcttgcgccgttccagcgctacgtgctggtgaagctgtcgcgcaagccgaagctgaaccacgatttcctgcccgcgatgcgggagttcgggctgacggccacgcactgaggtggccgcagccgggtggagggagcgccgttcggcgctcgtccgtcagagcggcggcagttgccgcggcttgcggtcggggccggtcgcgacgtaggtgagcgtcgcttcggtgaccttcacgatttcacccatcaggcgcatgcgctgcgcgtacacctcgacgtcgaccgtgatcgacgtgttgccggtgcgcatgatggtcgcgtagaagctcagcagatcgccgacgaacaccggctgcttgaacacgaacgagttgaccgcgaccgtcgcgacgcgaccgttcgcgcgctggctcgcggggatcgagccggcgatgtcgacctgcgacatgatccagccgccgaacacgtcgccgtggacgttcgcgtcgtgcggttgcgggacgacgcgcagcgcgggctgttttgcgggagttcgagggtcgaatcggtcatggcgggggctttcatcctgtaagaaacatgccgccgtgcgcaggccggccggcgagggcgccggcagcggcgcgaagcggcttctgcgacaatacaacgttcgcaaattgtacgagaaagtgagcgagccggccgccgatcacgcgcccggcaccgccgccgatccttcccctcatgcgccgatttcctgcttccggcgagcccgcgccggcttcgaccgggccccgcaacgactggcagaccatccggtcgctgctgccgtacctgaccacctacaaatggcgcgtcgcgctcgcgctcggctgcctgatcggcgcgaaggtcgcgaacctcggcgtgccggtcgtgatgaagcgcatcgtcgaccacctgtcctacgtccagcagatcaccgcgctcggccgcgccgaacagtcggccggcatcgtgctcgcgggcggcgtcgggttgctggtcgtcgcctatgcgctcgtgcggctgtcgacgtcgctgttcaccgaactgcgcgagatcctgttctcgaaggtcaccgagagcgcggtgcgccagctcgcgctgcaggtgttccggcacctgcacgggctgtcgctgcggttccatctcgaacgccagacgggcggcatgtcgcgcgacatcgagcgcggcacgcgcggcatccagcaactgatctcgtattcgctgtatagcatcctgccgacgctcgtcgaggtcgggctcgtgctcggcttcttcgtggtcaagtacgaggcgtattacgcgtacgtgacgttcgcggcgctggtcacgtacatcgtgttcacggtgaaggtcaccaactggcgtacgcatttccgccgcacgatgaacgaactcgattcgcgcgcgaactcacgggcgatcgattcgctgatcaactacgagacggtcaagtatttcggcaacgaggagtgggaggcgcagcgctacgacgagaacctcaagcgctaccggaaagccgcgatccgctcgcagaattcgctgtcggtgctgaacttcggccagcaggcgatcatcggcacggggctcgtgttcatcctgtggcgcgcgacgcaggggtgctcgcgggcaagctgacgctcggcgatctcgtgctgatcaacacgttcatgctgcagctgtacattccgctgaactttctcggcgtcgtctatcgcgagctgaagcagagcctcaccgacatggaccggatgttcgggctgctgtcggccgcgaaggaagtggccgacctgcccgatgcgcggccgctcgcggtcgccggcgcgcaggtgcgcttcgagcatgtgattttcgcgtacgaggcgtcgcggccgatcctgcacgacgtgtccttcacgatcgacgcgggcacgacgaccgcggtggtcggccacagcggctccgggaagtcgacgctgtcgcggctgctgttccgtttctacgatctcgaccggcaggcgggcggcgcgatccggatcgacggccaggatatccgcgacgtcacgcaggattcgctgcgtgcgtcgatcgggatcgtgccgcaggacaccgtgctgttcaacgactcgatctactacaacatcgcgtacggccggccgagcgcgacccgcgacgaggtgatcgcggccgcgcgcgccgcgcacatccacgatttcatcgaaagcttgccgaagggttatgacacgccggtcggcgagcgcgggctgaagctgtctggcggcgagaagcagcgcgtcgcgatcgcgcgcacgctgttgaaggatccgccggtgctgctgttcgacgaggcgacttcggcgctcgattcgcgctcggagcgggcgatccagcacgagctcgaccagatcgcgcggcatcgcacgacgctcgtgatcgcgcaccggctgtcgacggtcgtgcacgcgcagcagatcctcgtgatggatcacgggcggatcgtcgagcggggcacgcacgacgaactcgtgcgcgccgacgggttgtatgcgcagatgtgggcgctgcagcagcagcgcgcggcggcgggcggggaagaggccgaggccgcgtaggcgcgggtattgagcggtgcgcggcaggaacgggcggtgtggtgccgtcagggccgggtgacttggcggagcgtcggcgacatcggatcctggagcttggtccggcgccgatcggtcgcgcggtcatcgacaagtcggggtatcgaccgccgaaccgccgaaccgccgaaccgccgaaccgccgaaccgccgaaccgccgctcagccgctcagccgctcagccgctcagccgctcagccgctcagccgcccagccacccagccacccagccacccagccacccagccgcgaaacgatcagcccgcggcgcgcagccgcgcgtcgagctcgccgagctgcgcgggcgtgccgacgttctcccaaataccttcgtacagttcgccgctcgcgcggccggcttcgatcgccgcgcgatagtacggcgtcagcgcgcgccgcgtgccgggcgcgagatcgcggaacatccgcgtgtcgtacaggccgatgttgccgaacgtgaagcgcgcggcgccgtcgagcgccaggcggccgtcgtcgccgagcgcgaagtcgccggccgggtggaacggcgggttcggcaccatcacgaggtgcatcgccggcgcgtcgagcccggccatccgggcggcgcgcggcgcgagcgtccggtagtcgaaggcgcagtacacgtcgccgctgaccgccgcgaacacggccggttgtccgtcgcgctcgagcagcggcaacgcctgcgcgatgccgcccgcggtttccagtgcctcgccttcggccgagtacgcgagccgtacgccccagcgcgacccgtcgccgagcgcggcctcgatctgttcgccgagccacgcgtggttgatcacgatcgtctcgatacccgcgcgtgcgagcgcttcgatctgccacgcgatcagcggcttgccgcccgcttcgaggagcggcttcgggcgggtgtcggtgagcgggcgcatccgttcgccgcgcccggcggcgaagatcatcgccgtcgtcagggtgttgctcatgttcggccgggtgtcaggaaagtcggaacgatcagaacgtatagcccacgtcggccggcgcgttgccctcgagctcgtcgagcagcttcgcgaacggcacgagcgggcggtagcgcagcgcgaccttgcgcgcatacgcgatgaagcgcggcaggtcgttcaggtaatggggcttgccgtcgcggtaattgatgcgcgcgaacaggccgagcaccttgatgtggcgctgcagccccatccattcgagctggcggtagaactcgccgaaatcgggatcgaccggcagcccggcctttttcgccctttcccagtagtacgcgaagcagtcgagctcgaactcctcgtcccagctgatgaaggcgtcgcgcagcagcgacacgacgtcgtacgtcagcggcccgtagacggcgtcctggaagtcgaggatgccagggttcggctcgcacaccatcaggttgcgcggcatgaagtcgcgcagcatgaaaccctgcggctgcgcgtgggcgctcgcgaccagcagcgcgaaggtgcggtcgagcgtgccacgcatcgcgtcggtgacgggcttgccgaggtggcggccgacgaaccattcgggcatcagctccatctcgcggcgcaggaatgcctcgtcgaacggcggcagcacgtcgggtttcgacgtgagctggaagcggatcagcgcgtcgagtgcttcgcgcatcagcggtttcgcggcggccgggtcggccggatcgagcaccaagatgtacggcgtgcggccgagatcggtcacgagcatgaaacccgcgtcgaaatcgtgggccagcacgtccggcacgtggtcgccggccgcggcgagcagctgcgcgacctggacgaactcgcggcacttctcgggcggcggcgcgtcgacggcgatcagcgtgccgccggcgctcgtggccgacgcaatccggaaatagcggcggaaactggcgtccgacgatgcgggcgcgagggtcgacaggtcgagcgcgtagcgctcggcgagcgggtgcagccacgcggtgagcgcttcgaggcgggcgtcgggctgggatgcggcggatgggggcgtcatgaaactcggaggagggggaacgtcttgccatataataccccacgactttttgacgcaccccgcgtcagctttccgccgtgcaggcccgccgcctgtcgcgccgccacccgatcgcctcccggtttgcgctcagccgcagtcgcggtgcgacggcgcggcccgccgtgcgcgaatgtgccgcgacggcgcggctgacaaggggcgattcgccaaacgatagatgccgcccaaaccgctattcccgaatgttttccccggtgacggggtgccgcgcaaacggcggctcgcgctcgcgctcctggccgtgcccggcctcgtgccggccgtgtcgtacgcgcagctgtcgggcgcggccgcgcagccgcagccgctcgactcgccgtgggatctgcgtctcgcgccccagctcgaggatcgcccgctgaaggagggcgcgaagccggccgccttcgtgatcgccgaccacacgagcggcaccgccgagcaggatctcgccgcgaagggttcggccgagctgcggcgcggtgacgccgtcgtgaaggccgacgcgatccactacgatcaggatacggacatggccgatgcgtacggccaggtcagggtgatcaattccggcacgtcgttcgcgggccccgaggcgcacctgaagatcgaggcgaaccagggcttcatgacggcgccgaagtatcacttcaacgtgacgggcggctcgggcagcgcggagcgtgtcgacatggtcgacaacgagcgctcggtgttcgtcaacggtacctataccgcgtgccagtgctcgacgaaccccgcgtggtacatcaagggcagccgcttcgacttcgatacgggcgccgatgaaggcaccgcgcgcaacggcgtgctgttcttccagggcgtgccgatcttcgcgagcccgtggatgacgttcccgctgtcgggcgagcggcgcagcggcctgctgccgccgacgttctcggtgaactcgagcaacggcttcgagctgacgctgccgtactacttcaacatcgcgccgaaccgcgacctgacgctcacgccgcgcatcatctcgcggcgcggcgtgatgaccgaggcgacgttccgctacctgtcgccgtcgtattcgggcacgttcacggccaattacctgccggatgaccggctcgagcaccgcaaccgctacgcgatctactggcagcaccagcagaacttcggcggcggtttcggcggctacgtctactacaacaaggtctcggacaatctgtatcccgagcaactgggttcgtcgaaccagttcatcaacgggacgcagacgctgtaccagcaggaagcgggcctcacgtacaacaacggcccgtggtcggtgctcgcgcgctaccagcactggcagacgctgccgccgtcgatcgcgccgtacagccgcgagccgcagttgaacgtgaagtacacgaagtacaacgtcggcggcttcgacttcggcgcggaagccgactattcgcggttccgcatcacgacggccgacgcgaccgaaggcgaccgggtcgtcttcaacccgtacatcgcgtacggcgtgtacggccccggctacttcgtcgtgccgaaggtccagtaccacttcgcgtcgtacgacctgaactacctgtcgtcgaaaacgccgaacagcccgaagcgcttcaccgagtcgatcccgaccgtgagcttcgattcgggcctgatcttcgaccgctcggtgcgcctgttcggccaggatttcatccagaccctcgagccgcgcctgtactacgtgtacacgccgtatcgcgaccagtcgaacgcgccgctgttcgacaccgcggaatcggacttcggcctcgcggagatctaccagccgaacacgttcgtcggcaacgaccggatcgccgatgcgaaccgcatcacggccggcctgacctcgcgcttcatcgatccgcgcaccggcgacgagcgtgcgcgtttcgtgatcgcgcagcagtactacttcgccgatcagcgcgtcacgctgaatgccgggcagagtgcggtgctggcgcgtcactcggacctgatcgtcggggccgcgctgaagctcggttcgggtttcatgtccgagacggcgttccagtacaaccagaacaacaaccagctcgtgaagtcgagcgtcggtttcggctacagcccgggcgagcgccgcgtgatcaacgtcggctaccgctatacgcgtgcgaacaccacgctcgacaaccagccgatcaaccagttcctggtgtccgcacaatggccgctcacgcgccgcctgtatgcgatcggccgcttcaactacgatctcgccggcgatcgcgtggtcgacggtctggtcggcttacaatacgacgcggattgctgggcgctcggggtcggggtgcagcgggcggcgaacggcatcaattcgtccggacagcagaattcgtcgacgcgcttcatgatgcagctcacgctcaagggcctgtcgaccgtcgacaacggcctcgtgtccgcgttccgcgccggggtgccgggctacacgccgctgccgccgccgccgccgccgatgtcccgcttcagcaactacgagtaacgccggcttgtctgcaccggtcagcacgatttcaatggagttccagtggcaatgaagaaaacccttcgtttcgcggcagtcgtgtccagcctcgctgcggcggccgcgctgctcgcctctgcgccggccgcggcgcaggcgctcggttcgcaaggtgcgcagctcgccgacgaagtcgtcgcggtcgtcaacaacgacgtgatcaccggccgcgaactcgaccagcgggccggcctgatcgcgcgccggctgcagcagcagaacgcccccgtgccgccgaccgaccagttgcgcgcgcaggtgctgaaccagatggtgctcgagcgtatccaggtgcagaaggccaaggacgacgggatccgcatcgacgacgcgacggtacagtccacgctgcagcgcctcgcgcaggcgaacggcatgacgctcgaccagtaccgcgcgcgtctcgaggcgcaaggcgtgccctggagcatcttcacgagcgatgcgcgcaccgaactgatgctgtcgaagctgcgcgagcgcgaggtcgacggcaagatcaccgtgtcggacgccgaggtcgcgaactacatcgcgagccagcgcgggccgaacgcgtcgcagcagcaggacctgcgcttccagcacatcttcatcaaggcaccgaccaacgcgccgcaggccgacatcgaagccgcgcagaagaaggctgacgcgttgctgcagcaggcgaagtcgggtgccgatttcgagaagctcgcgaagaacaattcggaagcgaacgacgcgaagaagggcggtgacctcggcttcaagtcgccgagcgcgctgccggccgacgtcgtcgacgccgcatcgaagctgcgcccgggccaggtcaacccgacgctgatccgcgtgccggacggcttcgagatcgtgcgtctcgtcgatcgtcgccagagccagggcgcgtcggccgcggcaccgaagattgtccagacgcacgtgcgccacatcctgttgcgcgtgggcgaaggcaagtccgaaggccaggcgcgccagcaactggccgacatccgcaaccaggtcgaggctggcggcgatttcgcgaagttcgcgcgcacgtattcgcaggacggttcggcgtcgcagggcggcgatctcggctggatcagcccgggcgagaccgtgccggaattcgagcgcgcgatgaacaacctgcaggacggccagatcagccagccgatccgtaccgagtacggctatcacctgatccaggtgctgggccgccgcgaagcggaaggttcggtgcagcagcagatggatatcgcgcgtcaggcgatcggccagcgcaaggccgagcaggcgtatgccgactggctgcgcgagctgcgcgattcgtcgtacgtgcagtacaagatcggcggcgtcggcccggcgaactgagcgagcttccgatgaccacgcccgcgctgcagatcgcgatcacgaccggcgaacccgcggggtcggcccggaactgaccgttcaggcgctgcgtgatgccgcgcagcgctggcccgacgcgcatttcaccgtgctcggcgatgcggcgctgctcgacgcgcgtgcggcggccgtcggcgccgaccgggccacgctggccggcagcgggccggtgtcggtcgcgcatcacgcgctcgccgtgcccgcgcaggcgggcaggctggacgcggcgaacggcccttacgtgctcgggctgctcgacgcggcgatcgacggcgcgctggcgggccggtacgacgcgatcgtcaccgcgccgttgcagaagagcacgatcaacgatgcgggcgtgccgttcaccggccataccgagtacctggcggagcgcacgcatacgccgcgtgtcgtgatgatgctggccggtaccggccaccggccgttgcgcgtggcgctcgcgaccactcacctgccgctgaaggacgtatcggccgcactgacggtcgacgggctcgtcgagacgctcgcgatcatcgatcgcgacctgcggcgcgacttcggtctcgccgcgccgcgcattctcgtgacgggcctgaacccgcacgcgggcgagaacggttatctcggccgcgaggagatcgacgtgatctcgccggcactggcccgcgcgaacgcgcagggcatcgacgcgcgcggcccgtatccggccgacacgctgttccagccgcgtcacctcgccgatgccgattgcgtgctcgcgatgttccatgaccagggcctgcccgtgctgaagtacgcgacgttcggcgagggcatcaacgtgacgctcgggctgccgatcatccgtacgtcggtcgatcacggcacggcactcgatctggccggcacgggccgcgcggatccgggcagcatgatcgccgcgctcgacaccgccgtcacgatggcgcgccatcgccgcaccgcctgacgcggcccggctttacctcattcgtcgtatttttcgttttactcagtcgatgtcgaacagcagacagcaccaaggccatttcgcgcgcaagcgcttcgggcagaacttcctcgtcgatcacggcgtgatcgactcgatcgtcgcgacgatcggccccgcgcgcggccagcgcatggtcgagatcggccccgggctcggcgcgctgaccgagccgctgatcgcgcgcctcgcgacgcccgagtcgccgctgcatgcggtcgagctcgaccgcgacctgatcgggcgcctgcagcaacgcttcggcgcgctgctcgaactgcacgcgggcgacgcgctcgcgttcgacttccgctcgctcgcggcacccggcgacaagccgtcgttgcggatcgtcggcaacctgccttacaacatttccagcccgctgctgtttcacctgatgacgttcgccgacgcggtcatcgaccagcacttcatgctgcagaacgaagtcgtcgaacggatggtcgcggagccgggcacgaaggcgttttcgcgtctgtcggtgatgctgcagtaccgctacgtgatggaaaaatgctcgacgtgccgccggaatcgttccagccgccgccgaaggtcgattcggcgatcgtccggatgattccgtacgagccgcacgaactgccggatgtcgatcccgggctgctcggcgaaatcgtcaccgcggcgttctcgcagcgccgcaagatgctgcgcaatacgctcggcgactatcgcgagacgatcgatttcgatgcgctcggcttcgatctcgcgcgccgtgcggaggatgtgagcgtggccgagtacgtcggcgtggcgcaggcgctggcgaaggtgcgcaaggccgcggagtaacggcagcgcgtgcgtcatgcgcgcgtcgcacgccggctcgaggttcgcaaggctgccctggcgggcagccttttcattttccccgcgccgtattcgtcgatgcggggccgcgaccggtgtcgttacgcgcgccgttgcggcggcgcgttgacgagcgcgatgcccgtcagcacgagtgcggccgccgacatgaagcgccagccgacggattcgccgagcagcagcacgccgaacgcgacgccgaacagcggcgacaggaacgtgaagacggacagacgtgatgcgctgtagcgcgtcagcagccagaaccacgacaggtagctgacgaacgcgacgatcaccgactggtacgcgaggctcgcgaccgcgaccggcgtgacgtgcgcgaacgacatctggccgaacagtgcggccagcgcgaccagcacgaccgccgataccgcgagctggtagaacagcgtcttgctcgcgctcgcccgtgcgagcgccgtcgagcgtacgacgacggtcgtcgcggcccacatcgcgccgccgaggatcccgagcgcgtcaccggcgagcccggccagcacggatgcgccggggcgcgcggcttcaggaagccgtccgcgaacgcgagcgcgatgccggcgaatgccaggccgacgccggcccactgcgtgcgttgcagccgttcgccgggtgcgaacaggtgcaggcccagcgcggtgaagcacggcgccgtgtacaggaagatcgccatgtgcgacgcgctcgtcagcgtcagcccgaagaacacgcagatgaattcgccggcgaacagcgcgccggccgcgaggcccgcgccgaacgtgccgtccgcctgaaacagcggcgtaccgcgcgagcgggcccagccccacagcagcgccgccgcgatcaccgagcgcagcccggcctggaacatcggcgcgatcgcggcgttcgtgctcttgatcgcgacctgctggaagccccagatcgcgcacagcagcagcatcaggccgacggcgcgcatgtcgagcgcgcggcgcacgggggcagcgagtgcactcatcggcgaacctcgccggttcggtgcggcggctgcgagatcgggagggggcgcatccggcgcgctcgaatcggcggtgtcgcacggcagtgtggcggtaggggagtgagtggtcgcgttcgggcggtgggtcgcatgcccgcttttggtgcgaggtggaaggatgttacccgatccgctcggtagtcgggcgagcaggggcgtgctgttttccgcgttgcccttgcgccggcaggcgttacccgccgggcgtccccggccaggcgccccgagctgggcgccccggctaggcgccccggcgaagttcacccgactctggtagagttcccggttctggaaagtccccacaggagtacaacacatgcgattgctgcatacgatgctgcgagtcggcgatctcgaccgctcgatcaagttctacaccgaattgctcggcatgaaggtgctgcgccgcgacgactatccggaaggcaagttcacgctcgcattcgtcggctacggcgatgaaagcaacaacacggtgatcgaactgacccataactgggataccccgtcctacgacctcggcacgggtttcggccatctggcgctggaagtcgacgacgcgtacgcggcctgcgacaggatcaaggcgcaaggcggcaaggtcacgcgcgaagcgggcccgatgaagcacggcacgaccgtgatcgcgttcgtcgaggatccggacggctacaagatcgagttcattcagaaaaaggcgcactgagcgccggatgaaccgggccgtggcgtgcgatgtgcgcggcggcaaaaagggcgatgcggaatgacccgcatcgcccttttcgttggcggagaagccgtgcgcgtcaaagcgacggcagcagctcgggcgggtgatgcttgagcgtgtggcgcgcttcgcggaactcggggaagatcgactcgacggtctgccagaaggcggggctgtggttcatttcgcgcaggtgcgacaactcgtgcgcgacgacgtagtcgatgatcgacatcgggaaatggatcagccgccagttcaggcggatcttgccgtcgctcgagcaactgccccagcgcgtcgcggccgacgacagcgcatacatcgaatacgtgacgccgagcttctccgcgtacaccgcgaggcgttcaccgaagatccgccgggcttcgccctgcagccagccctgcacgcgatccttgatctgctgcatgtcggcctgcacgggcagcggcagcgagccgcaacgcatcggcgtcgaatgcgacggcgcccgcgccgagcgcgatcgtcaccgtcttgccgagatagggcagctgcgcgccgtcgcgccagtcgatctgcggcagcgcgcgctgctcggtgcgcgtcttccactcggcgagcttcgcgaagatccagcgttgtttctcggcgatcgcggcttcgatgtcggcgagcgtgacccagcgcggcgcggtgatcgacagcccgctgccgtcgatcgtgaagccgatcgtccggcgcgccgagcgcttcaggcggtattcgagcacgcggctgtcgagtgcgaacgtccgcacgcgcgagcggtcgggcgcggggcccggatcgaggggcgcagcgggggccgcttcggtcggcgcgggcggggcggcgggcgccgacggcgcggcggccggcccgtcgaagagcggcagatccatctggcgatgatcgagggccacgacggcaggccgtggccgcggacgctgtttcatcagttcgcttctttttgtcgtacgcaacggctgccacccggggcgtcagacacgcgcggcatcgcgcgtgccggcgttgcccgcctggcgatacgaatccggatcgatccggcgcatttccgcttcgatccatgcttcgacctgcgagttcaatgcatcgggcgtcagccctcgctgggaatcggcttgccgatcgacacggtgacgacgcccgggaatttcgtgaacgagttgcgcggccacacccggcctgcattgtgcgcgatcggtacgacgggtgcgccggtttcgatcgcgaagcgcgcgccacccgtcttgtacttgccctgcttgccgaccggcgtgcgcgtgccttccgggaacatgatcatccatgcgccttccgacaggcgcttcttgccctggcggatcaccgacgtgaacgcgttcttgccttccttgcggttgatgttgaccatgtgcagcagcccgagcgcccagccgaagaacggcacgtacagcagctcgcgcttgaacacgtagcagagcggtttcggcatcagcgcgggaaacgcgagcgtttcccatgcggactggtgcttcgacagcagcacggccgggccgtcgggcaggttctcgtagccttcgatccggtagcggatgccgttcagccagcgcacgacccacagcgtggacttgcaccagccggccgccatccagtagcgcgcgtcggcgcgcatgaacggaaaggcgatgaagcacgcggtggcgtacggcaccgtgtacacgacgaagtagatcagcagcagcagggagcggacgaagcgcatcggcgtaagtctggcgttagggaggatgcgcgcggcggccgcatcactcgtgttcgtgtgaaaggaaatcgagcgcgaacgcgcgcaggtcgtcgtggaccttcgtgccgggcggcaggttgccggcggcgagcgtcttcttgcccttgccggtgagcacgaggtacggctggaagccgaccgcgacgccggcctgcaggtcgcgcagcgaatcgccgaccaccggcgtgtgatcgggatcgatctcgaagcgctcggcgatcatctgcatcatcccgggtttcggtttgcggcagtcgcagtgatcctcggccgtgtgcgggcagaagaacaccgcgtcgatccgcgcgccgaccgcggccgccgcgcgatgcatcttcaggtgcatctcgttgagcgcggccatgtcgaacagcccgcgaccgatgccggactggttggtcgcgacgaccacgcgataccccgcgtggttgagccgggcaatcgcctcgagggcgccgggcagcgcgatccattcgtcgggcgtcttgatgaacgcatccgaatcgacgttgatcacgccgtcccggtcgaggacgacgagctttcggttggggctggtcggcatcgtgcggcccttatgcggcgagcttcgagatgtcggcgacgcagttcatctgctggtgcagcgcggacagcagcgcgagacggttcgcgcgcagtgccggatcttccgcgttgaccatcacgtcgttgaagaacgtgtcgaccggtgcgcgcagcgcggcgagcgccgacagcgcgcccgtgtacgcacgcgcctcgagctgcgactgcacgtgcggcgtcacggccgcgagctgttcgtgcagcgccttctcggcggcctcgacgagcagcgtcggctgcaccgcaccgttcgcgccgccgtccgacttcttcaggatgttcgagatccgcttgttcgcggccgcgagcgcttcggcttccgcgaggtgcgtgaattcgcgcaccgcgtcgaggcgcgcgacgagatcgtcgacgcgcgtcgggttcaggctcagcaccgcatcgatttcgccggccgaatagccgcgctcgcgcagcaggccgcgcaggcgatccatgaagaacgcgaggatcgcgtcggtcgattcggcgacgcccggcacgccttcgaagcgtgcatgggccgtgcgcagcagcgacacgagatcgagcggcagctgcttctcgagcagcaggcgcagcacgccgagtgcgtggcggcgcagcgcgaacggatccttctcgccggtcggcgcgaggccgatccccagatgccgacgatcgtctcgagcttgtcggcgagcgcgacggcggtcgacacgggcgtggtcggcagtgcgtcgccggagaaacgcggctggtagtgctcggcgcacgcgagcgcgacgtcgtcggcttcgccgtcgtggcgcgcgtagtacgtgcccatcgtgccctgcagttccgggaactcgccgaccatgtcggtcagcaggtcggccttcgcgaggcgcgcggcgcgcttcgcgtgcgcggcgtcggcgccgatcgcgggggcgatctcgccggccagcgcctcgaggcgctcgacgcgcgcgagcgccgaaccgagcttgttgtgatacacgacgttcgcgagctgcggcacgcggtcggcgagcggtttcttcttgtcctgctcgaagaagaacttcgcatcggcgaggcgcgggcgcacgacgcgctcgttgccttcgatgatctcgcccggcgtcttcgtctcgatgttcgacacgatcaggaagcgcgagcgtagcttgccgccgacgtcggtcagcgcgaaatacttctggttcgtctgcatcgtgaggatcaggcattcctgcggaacctgcaggaattcgtcctcgaagcggcacgggtagacgaccggccattcgaccagcgacgtcacttcgtcgagcagtgcttcgggcatcacgacggaatcgccgttcgcgtgttcgttcagctgcgtgcggatcgtttcgcggcgatcggcgaagtgcgcgatcacgcggcccttgtcgcgcagcgtgtcggcgtacgcgcgtgcatgctggatcgcgacgaggccgtcggacaggaagcggtggccgagcgtcgtgtcgccggcgtcgacgccgaatgcggtgacgggcacgatgcggtcgtcgtgcagcaccgtcaggcgatgcaccgggcgcacgaacttcacgtcggagccgtccgggcgctggtaggtcatcaccttcgggatcggcagcttctcgagcgtttcgtcgagcgcggcctgcaggccgtcggcgagcgtcgcgccggctgccgaatagttgatgaagaacgcttcggccttgccgtcctgtgcgcgctcgagatcggcgatcgacaggttcgggtggccgagcgccgcgagcttcttcgcgagcggggcggtcggcttgccttcggcgtcgagcgcgaccgacacgggcaggaccttttcgcggacctgcttttcaggtgcgacggcgcgcacgttctgcacgacgacggcgaggcggcgcggcgtggcgtagcgttcgaacacgagttcgccgtcgacgaggtcgcgtgccgcgaggcgttgcgcgaggccttcggcgaatgcgtcgccgaggcgcgcgagggccttcggcggcagctcttcagtcagcagttcgacgagcagggggcgggatgattgtgcgtcatgtctggattgaatctcgtctcgtcagtcctgatcgatcttgcgttcgaccttgagcggcggcgcccatgccggctgggcggcgtcctgggcgtcggtggtgaggcccggcacgcccggcgggttgccgagcatcgggaagccgagcttctcgcgcgagtcgtagtaggcctgtgcgacgagacgcgacagcgcgcggatgcggccgatgtacgccgcgcgttcggtgaccgagatcgcgccgcgcgcgtccagcaggttgaacgtgtggccggccttgagcacgagctcgtacgcgggcagcgcgagctgcgcgtcgatcatcttcttcgcttccgcttcgtagctgttgaagaacgtgaacagcaggtcgacgttcgcgtgctcgaagttgtaggtcgactgctcgacctcgttctggtggtagacgtcgccgtacgacaggcggcgcagctcggggccgttcgggccttgctcttcccactcggtccacacgaggtcgtacacgttctcgaccttctgcaggtacatcgcgaggcgctcgaggccgtacgtgatctcgccgagcaccggcttgcagtcgaggccgccgacctgctggaaatacgtgaactgcgtgacttccatcccgttcagccacacttcccagccgaggccccacgcgccgagcgtcgggttttcccagtcgtcctcgacgaagcgcacgtcgttctgctgcaggtcgaagccgagcgcctcgagcgagccgaggtacaggtcgaggatgttttccggtgccggcttgagcacgacctggtactggtagtagtgctgcaggcggttcgggttctcgccgtagcggccgtccttcgggcggcgcgacggctgcacgtacgcggcgcgccacggctcggggccgaccgcgcgcaggaacgtgtgcacgtgcgacgtgcctgcaccgacttccatgtcgatgggctggagcagggcgcaaccctgcttgtcccagtaggactgcagcgtcaggatgatttgctgaaacgtaagcatgaagagccttcgtggcgctggcgctccgttgcgggcggcactccgggcggggcccggagagtcggctcgcgcggcggcgcggcttgttagtgtgctgaaacgcgtaattttaccggatcggcgagcggatgcggccggaacgcgggcgggcgtgtcgtcggccccgtccgggcggcctgcgcgggcgcggccggcgcgcaccgggcggccgcgcgcggcaggtcgcgacgcgcgtgccgcacggcttcgcacgggcgttaagatgcgcgtattgcggtgcgcgcggcgcgtgccgcgccaccgcttgccgatcccgactgcatggacgatccgaccgacatcctcattccgctgcttccgcccttcctcgcgctgctcgggcaggccgccgacgcgcaagcgcgcggcgaggccgccgcgcacgatctgtggctggccgccgccgcgcacctgcatgcggtcgacgccgatgcgctcgcgcagctcaccggcgcgctcctcacgcggcagcgcacggccgatgcggtcgcgctcgccgaatgcgcggcgcgcgtgcagccgggcgcgaccgcgtacttcaatctcggctacgcgctgcagatggcgggtcgtcacgcggacgccgtggcgccgtatcgcgcggcgctggcgctcgacgccgggcggccgtcgctgcgcaacaacctcgcgatcgcgctgcggctgtcgggcagcgaccgcgcggaggagatcgcgctgctcgacgcggccgtgcgcgccgatccgcgcgacgtgcaggcatggatcaacctcgtcgtcgcgcggatcgcgacgcacgacctggacggcgcgctcgcgtgcgccgcgcggctcgtggagatcgcgcccgacaacgcgctcgcgatgaacaacgtcgcgatggcgatgaaggaggcgcagcgctgggacgatgccgagcgcttcgcggcgcgcgcgtgcgagctggcgcccgacgacgcgtcctaccgtttcaacctggcgatcatccagctcgtgcgcggcaaccacgcggccggctggcgcggccacgaggcgcgctgggacggcgcgggcgagttgcgcggccgccggccggtgctgccgggcccgcgctggcagggcgagccgcttgccggcaagacgctgctcgtgtggggcgagcaggggctcggcgacgtgctgcagttctgccgcttcgtcgcgccgctcgccgagcgcgtgcatcgcgagggcggccggctcatatggaatacgttcccgcaggtgggcacgctgatgcagcgcagcctcggcgcgcatgcggatgcgttcagcgcgggcggcggcgtcgacgtgctgcccgccttcgattacgaaataccgctgatcggcctgccgctgatgctcggcatggaagcgtcgacgctcgcgtcgtcggtgccgtacctgcgtgccgatccgctcgcgcgcgacgcgtggcgcgcgcggctcgcgggcgacagccggctgaaggtcgggctcgtgtggacgggcagcgcggggcatcagcgcaatccgttccggcgcgtcgggctcgagcgttatgccgacgcgttccgcgggatcgacggcgtcgcgtttcattcgctgcagccgggtgcgcaggcggatgtcgcggcggcgcgcgcggccggcttcgcgatcgaggacttcacggcggaactgacgagcttcgacgatacggccgcgttcatcggcgcgctggatctggtgatcaccgtgtgcacgtcggtcgcgcacctggcgggcgcgctcggcgcgcgcacgtgggtgctgctcgacgtgaatccgcactggccttggctgctcgaacgcacggacagtccgtggtacccgaccgcgacactgtaccggcagccggcgttcggcgcgtgggagccggtgatggagaaggtgagccgcgacctgcggcgcctttctgcgcagccggttcaggcggcggagtcggcggagtcggcgcggcagggctgagcggccggctggttcgcggtcaacggccgctgcatgcggcggccgccaccacgcgctgcgcggcggcggcgtgccgcatcatttcggcggggcgtcgacgttgttccggccgttgcgccggcgcagcccggggccgaacgtgaagccgaacgcgagcagcacgaacgacaccgcgagcacgatgttgttgccgctcgtcacgtaaggcgtgaagccgctcgtgccttcgatccgcacgtcgagcgagccgatcgtgaacggcttcagctggccgagcacgcggccgcgcgcatcgatcgcggccgtcatccccgtgttggtcgagcgcagcatcggccggcccgtctcgagcgagcgcatccgcgcgatctgcaggtgctggtcgagcgcgatcgtgtcgccgaaccacgcgaggttcgtcacgttgacgagcacgcccggcggctgcgggttgtcgcggatcgtcgcggcgatttcctcgccgaacaagtcctcatagcagatgtcggccatcaccggctggttgtgcacgaggaacggcttctgcaccggcgcgccgcgcgcgaagtcgccgagcggcatcttcatcaggtcgacgaaccaccggaagccccacgggatgaattcgccgaagggcacgaggtggtgcttgtcgtagtgatagatgtcgcgcgaattcggcgtcacgccgtacaggctgttcgtatagtcgacgtagtggccgtcctcggtcaccgatgcgccgaccgcgccgaacagcacggccgagcccgtcgtgtcgctgaacttgcggatcgcgacggcgaacggctcgggcaactcctggatcatcaccgcgatcgcggtttcgggcgtgacgatcaggtcggccggcttctcgacgatcatctgcgtgtacatcttgatcgccgcgtcgatgcccgcttcctcgaacttgatgtcctgcttcacgttgccctgcagcagccgcacggtgagcggcgcgttcgcgggcacggtccacgtgacctgcgacagcccgagaccggccgcgatcagcgcgaccgcgatgccggccggcgcggcgatgcgcacgcgcgcattgccggcacggggttcggcgagcggcgtcggccgggcggcggcgagcgcctgcacgacgagcgcggcgaacaaggcgagcacccacgcgatcccgtacaccccggcgaccggcgcgaagcctgcgaacgggccgtcgacctgcggatagccgcttgcgagccacgggaagccggtgaagacggtgccgcgcagccattcgccgagtgcccatgcgctcgcgaatgcgaatgcgccgtgccaggtcggcgaaaacggcctcgggtcgggcgtgcggcgatgccacgcatggcctgcgcagaacgaccacagcccggcggagaacgccgggtacagcgacaggtacagcgagaacagcacgagcgcgccgcccgcgagcggcgcggccatctcgccgtagacgtgcatgctgatgtagagccaccagatgccgctgatgaagttgccgaagccgaacgcgccgccggtgagcgcggcgctgcgccaactcgcggtgcgcgtgagctgcgcgaaaaaccagacgaatacgacgagttgcagccagccgccatgcggcgtcggcgcgaagctgagcgtattggcggcgccggcgagcagcgcggccgggtagtgccagcgcggcagcgcgcgcccgggaggcggcgcgagaaggccgccagccgggcgggacaggatcggatcgtccatgtgaagcgaaagtgggcgagcggttgtggaacgcgcggctggcgcgcgacggtcagtcctcgtgcgaggtttcggcgcgacggctggcgagcgggttgcggcgcaccagcagcacgtggacctggcgcgcatcgccgcgctggatctcgaacacgaggttgccgagctgcagcttctcgccgcgatgcgggacgcggccgaaatgatgcgtgatcagcccgccgatcgtatcgacttcgtcatccgggaaatcggtgccgaacgtctcgttgaactgttcgatctcggtgagcgcacgcacacggtagcggccgtcgggccccgagatgatgttgccggcttcctcgtcgaaatcgtattcgtcctcgatgtcgccgacgatctgctcgagcacgtcctcgatcgtgatcaggcccgcgacgccgccgtattcgtcgacgacgatcgcgaggtggttgcggttcacgcggaagtcgtgcagcagcacgttcaggcgcttcgattcgggaatgaacacggccgggcgcagcatcccgcgcacgtcgaattcctcttcggcatagaaacgcagcagatccttcgcgagcagcacgccaatgacgttgtcgcggttctcctcgtacacggggtagcgcgaatgcgccttttcgaggacgaacgggatgaaatcctcgggcttgtcggcgatgttgatcgcgtccatctgtgcgcgcggcaccatgatgtcgcgcgcgcacaggtcggacacctggaacacgccttcgatcatcgacagcgaatcggcgtcgatcaggttgcgttcgtgggcgtcctggaggatttccagcagctcgccgcgggattcgggctcgggcgagatgaagtcggtcaggcgctcgagcagtgagcgcttttcttgcggtttgtcggttggcttacgactgggatacgaatcgttcatggtggtgcgcccgggtcatgccggagcgcgctgtcacggagtaggcaaggatacaccaagggcacgacgcgaccgtgtcacaccggccgcccggccagggtgggcagcgcgtacgggccccgctctcggacggccgcgccgggcgcgacatcgtcctcgcgtccatcctatcccagaaaagggcggcagggcagcggcgaaaaacgggtgcgggtgggaagcggagccgtgacgcggaaaagcgttcggccgcggcggtgagcggcggcattctgccgcacgcgggcttcgcccggccgccgttcagaaccgcatgccggccgagcagccgccggcggccgcgccgttggtcgcggcgccgccgcagccgagtattccgcagccggacagcgcgacgctcgcggcgacgatcagcgcggcaaccctccaacgcgaccagcgagacggtttcatcggtcttgtcctcgcaagaatgcggccacggcgcggcagcgcgtggcggcgagccgggcgtcgtgccgcgtcaccggcatcgcgcgagcagcccttccagcgcgcgatcggggatgccgctcgcgcgcagcgcgtcgaccgtgcggctgacgtagtcgagcgtcgtgccgtagcggccggccgcgcaactgaacacttccttgacgacgggatcggacagcttgcccgtataggtcggcgcttcgcggcgcatcacgaacgcgagtgcgttcacgcgctcgccgttctcgagcgaacacggcagccacgcgggccggtacgaacccatcggcatctcgcgtttccacaacgtttcgaggtgcggctgcgcggtcgggccggcgagccggaacgcgatgcccgagcacgagccgccgcgatcgagcgcgagcacgaggccggggcgttcgggtgtgccgcggttcacgcgcgaccacaggtagagcccgcgatgatagccgtgcaccttgccgcgtatggctgcgacggttggcagccccgggttccagatcagcgagccatagccgaacagccacagatcctggcggccgtcccagtcgcgcatcgtgtgcgcgagcgacgccgcgagttcgtcttccgtcagcaggcgcccgtcgccgatcgacggcgggtaggcgggcgagagcgtcgcggcgttgcgcatcgtgcggacggcttactggtacgggttcgggaagcccagcttcgcgaggatgtcgacttcgagcgcttccatttcggctgcgtcctcgtcgctcgtctcgtggtcgtagccctgcgcgtgcagcgcgccgtgcaccagcaggtgcgcgtaatgggcggtgagcggcttgtcctggtcgtgcgcttccttctcgacgaccgggcagcacagcacgaggtcgccgatcacggtgccgtcgggcgccgcgtcgtacgcgaaggtcaacacgttggtcggatagtccttgtggcggtagccggcgttcagcgtgcggccttcttcttcgccgacgaagcgcacggtgaactgcgcgctggcgaacagcgccggttcgagccattcggcgatcagcttgcgcttgggcagcgtcttgcgcacgtcgctcgtgatctcgtcgccgtactgcacggacaggtcgagctccggctcgcgcagtgcgtcttcggtgtcgtcctcgcgcggtgcgggctcggcgcccacgtgcagcgtcacgctgtcgtagtgctcgggctgcagcgcgatcttcgcgcgcatggccggatcgttgtgctgcgcgacgatcgcgacggcggcttctccggaactgcccgacaggtcgaacatcaggctgcggccgtcggggaagtcgatgcgcagcccttgcgcgttgacggtcgggccttgcctttcgcatcgaacagcgaaaggcgggggaggcgggcgcggcggactgggcgcgcccggacttgcgggaacgggaggatttcatgacgcgtgcggcgattaggacgcgttgaggatacaccaaacggccgatcgcacccgaattcacgcaggcgaaaaagcccggcgcgccgtctggcgggccgggccgggctgtcaggccgggcggcgtgcaggtgccgccggccggtcagccgtcctggtgctgcgcgtggaattcgtcatacgcctcgacgatgcgcgcgacgagcggatggcgcacgacgtccgcgctggtgaagcgcgtgagcgcgatgccgcgcacgccgccgagcacctgctgcgcctcgacgaggccgctcttgtggccgcgcggcaggtcgacctggctcgtgtcgccggtcacgaccgccttcgagccgaagccgatccgcgtgaggaacatcttcatctgctcgggcgtcgtgttctgcgcctcgtcgaggatgatgaacgcgtggttcagcgtgcggccgcgcatgtacgcgagcggcgcgatctcgatcatctggcgttcgaacatcttcgccgtcttgtcgaaaccgagcaggtcgtacagcgcgtcgtacagcggacgcaggtacgggtcgaccttctgcgcgagatcgcccggcaggaagccgagccgctcgccggcctcgacggccgggcgcgtcaggacgatccgcttgacctgatcgcgctcgagcgcgtcgaccgcgcaggcgaccgcgaggtaggtcttgccggtgccggccggcccgatgccgaacgtcacgtcgtgcgacaggatctgcttcaggtattcgcgctgcgccggcgtgcggccgcgcaggtcggcacgccgcgtgtagagcttcggcgcgggctcctcgtccggctcgctggcgtcgagctggacgacggggtcgtcgaacggatggtcggggtcgccgcggaagcgcacgtcgatcgtgtcctggcggccgttgccgcccgtgtggcgcacttcgaccagcgcgagctggatgtcgtcgaccgacagcgcatcgcgcgcgcggttgtagaagttctcgagcgcggccagcgcgagcttggcgccgcgcccgcggattgcgatccggtggccgcgtcgcgacagcgtgacgtcgagcgcctgttcgatctgccgcaggttctcgtcgagcgggccgcagaggttggcgaggcgcgcattgtcgtcgcgcggcgcgacgaattccagtgcttgggtcggcttcaaagtggcgtcgggctccagtggaacgtcagtgcgtggccgcgctcgcgtcgtcgctcacgagcacgagctcgccgcgcagcgaatgcgggtacgcgtggttgatcttcacgtcgatcatctggccgatcaggcgcgggtgcgatgcgagcggcgccgggaaattcacgacccggttgttctcggtgcggcccgcgagttcgttcgggtccttgcgcgacgggccctcgacgaggatccgctcgaccttcccgaccatcgactggctgatgcgcgcgacgttttcctcgatggtcgcctgcagatgttgcaggcgtttgagcttcacctcgcgcggcgtgtcgtcgtgcaggttcgcggccggcgtgccggggcgcgggctgtagatgaacgagaagctggtgtcgtagctcatctcgtgcacgagcgccatcatcttctcgaaatcctcctcggtctcgccgggaagccgacgatcatgtcggtcgacagcgacaggtccgggcggatcgcgcgcagcttgcggatcaccgacttgtattcgagcaccgtgtagccgcgcttcatcgccatcaggatgcggtcggagccgtgctgcacgggcaggtgcaggtggctcacgagcttcgacaccttcgcgtaggtgtcgatcagccgctgcgtgaattccttcggatgcgacgtcgtgtagcggatccgctcgatgccggggatgtcggcgacgtattcgatcagcgttgcgaaatcggcgatctcggacgagccggccgccagcgcgccccgataggcattcacgttctggccgagcagcgtgacttcgcgcacgccctggtcggcgaggccggccacttcggtcagcacgtcgtcgagcggacgcgacacttcatcgccgcgcgtgtacggcaccacgcagtagctgcagtacttcgagcagccttccatgatcgacacgaacgcgctcggccctcgacgcgcgccggcggcaggtggtcgaacttctcgatctcggggaaggtgatgtcgacctgcgcgcggccgctctcgcggcgcgcgtcgatcatctgcggcaggcggtgcagggtttgcgggccgaacacgaggtcgacgtacggcgcacgcgacacgatcgatgcgccttcctggctcgcgacgcagccgccgacgccgatcagcaggccgggcttcgcttccttcagctcgcgcacgcggccgagatcggagaacaccttctcctgcgccttctcgcgcaccgagcacgtgttgaacaggatgatgtccgcgtcttccggcgtgtcggtctttcgaggccttcggccgcattcagcacgtccaccatcttgtccgagtcgtactcgttcatctggcagccgaaggtctttacgtaaactttcttggtcatggggattcgccgttcgcagtggttgacctgggggcgtcgtcaagagtgaatcgggacggcggcgcgcgcgcacgcggatggcgcgcagccggcatgtgaaaagccgtcgggaaagctttccattatagcttttcacgctgcccgggacgggcggcgggttgcggccgcgcgacgccggccggcgcgttccgaccctcgagccgcgatgcgccggccgtcagcggcacgcgttcagcaggtcgtcgtgcgcggcttcctcgcgcgcgaagcgttcggcgagaaagtcgagcagcacgcgcacgcgcggcgccatgtagcgcttgccgggatagatcgcgtgcagcggcgcgctctggtgccgccagtcgggcagcaggaccttgagccgcccggcgcggatgtcgtcggcgacatcccagatcgagttcagcacgatgccgcggccgcgcagcgcccattcgcgggcgaggccgccgtcgttggtctcgaacgcggtggtgagcggcaccgtgcaggtctgcgtgtcgtcgccgcgcgtgaagcgccacgtgttcatcggcccggacgcgaccgtgatcacgttgcatggaaagcgggccagatcgtgcggatcgcgcggcacgccgtggcgttcgacgaacgacggcgccgcgcacggcacgcgccggtccgcggcgagccggcgggcgatcagcgcgccgtcgggcggcgcggcgaagcggatcgcgaggtcgatctcgtcctgccacaggttcaccgtcgagtcggacgccgtcagcgagaacgtcacgtccgggtgaagcgcggtgaattcgtcgagccagtcgagcagccggcggcggccgaaatcggacgtcgccgacagccgcacccggccggcgaccacgttgcggccggcctggagcagcgcgtttgcgtcgtcgagcgcctgcaacgcctgccggcagccgttcaggtacaggcggccctcgtcggtgagccgcaactgccgggtcgaacggtcgaacaaccgggtggcgaccgccgcctcgagtttcgcgaggcgcgcgctcgcggcggccggcgtgaggttcagcttgcgcccggcggcggacaggctgcccagttcggccgcctcgacgaacagccggatatcgcccagtcggtccatgcgattttccagaaatatttgaaaatggttcaaacgccacgccaattatcaaatatcgatgtcttcgggacaatgcgcacatcctgccttttgtgcggtgcggcaccgaccggacgccgcgtccgccgtcttttcggagaacgtcatgcccattccgttactggcgcttgcgatcagcgccttcgccatcggtaccaccgagttcatcatcatgggcctgctgcccgaagtggcgcacgacctggccgtgtcgctgccgtcggccggcctgctggtcaccggctacgcgctcggtgtcgcggccggcgcgccgctgctcgcggtgctgacgagccgcatgccgcgcaaggccgcgctgcagctgctgatggcgatcttcatcgtcggcaacgtgctgtgcgcgaccgcgtccggctacgcgatgctgatggtcgcgcgcgtcgtcacgtcgttcgcgcacgggtcgttcttcgggatcggcgcggtggtcgccgcgtcgctcgtgccggccgacaagcgcgcgagcgcgatcgcgctgatgttcacggggctcacgctgtcgaatgtgctcggcgtgccgttcggcacgttcgtcgggcaactgctcggctggcgcgcgtcgttctggatcgtcgccgtgctcggcgtgctggcgctcggcggcgtcgccgcgctcgtgccgaaccgtcacgacagcgggccggccggcctcggccacgaagtgcgcgtgctgaaggagccgcaggtgtggctcgcgctgttgatgaccgtgctcggcttcggcggcgtgttcgtcgtgttcacgtacatcgcgccgattctcgagaccgtgtcgggtttctcgccgcgctcggtcgcgctgatcctcgtgctgttcggcgcggggctgacgatcggcaacacgctcggcggcaagttcgccgaccgcgcgctgatgccgtcgctgatcgcgatcctcgtcgcgctgatggccgtgatggccgtcttcgcgaagacgagccacctgccggtcgcggccgccgtcaccgtgttcgtgtggggatcgccgccttcgcgacggtgccgccgctgcaggcgcgcatggtcgagaaggccgcgagcgcgccgcatctcgcgtcgacgctcaacatcggcgcgttcaacgtcggcaatgcgggcggcgcgtggctcggcggccttgcgctggaacacggcctcgcgctcgatgcgctgccgtgggtcgccgtcgcggtgacgttcgcggcgctcgtcgtcacatggttcgcgatgcggctcgacacgcgcgggccggcacgcggtgcggcgccggcggcgcaatgagcgagccccgcgacgcgacgcgatagcggcaggaaacggggcgcgagaaacgcattcctccgcgatgctgataacggtgtgaagataacttcgtttgccggtgcaaggccgggtgatagcgtttcgatacgcgccgttgctggcgcaacccgattccccatcccggcttaccccatacgcagggccgcacagcggcccggaggcaatgctatgtcttcatccctggcgctcgtgcgcgacgtgtcttccttcgagtccggcgacgccgccgatgcgcgggcgtccgcgtcgctcgatgttctcgagcaggtcgtcggcgtgaacctcgcgcggttgcgtgccgagcggcagttgtcgctcgatgcgctcgcgcggctgtccggcgtgtcgcgcgcgatgctcgcgcagatcgagtcggcgcgcagcgtgccgtcgatcaaggtcctctgcaagatcgccgcggcgctgaaggtttcggtcgccgcgttcctgcgccgccatgcggtgaacggcttcgagcacctggcggccgagcgcgcgtcgcgcgtcgtcagctcgaacggccgcttctcggcacgtgcgctgtacccggaaggcgagccggccgcggccgaattccacgaactgcggatcgcgccgctgcacacggagcccggcgcacgccgcgcacccggcacgacggtcaacctcgtcgtcagcgagggcacgctggaagtcagcgtgcacgaccgccgccagttgctcgcgaccggcgatgcgatcgtgttcgatgccgaccagccgtacagcctgcgcaacccgggcgacagcgaggcgcgcgcgtttcgcgtgacggtgagccccgaggtgccgccgcgctggctcgtgcccgatgcggcacatgccgcgcacgcggccggctgatcgcgcaggccgcccggagcggatcgcgttcccgtcgttcgcgcgggatcgcgggtcgtccgtcggccgttcggacgatgccgttagacggggtcgtcggtaaggttttagctggagttcactgcgccgcgcgcagctgttgtatgcttggcccgccgctgacggggttgtcccgtccggcaatcagtgcgtcttcagggcggggcgaaattccccaccggcggtaggctggcgtaagccggcgagcccgcgagcgctcgcgcatccgcgcggggtcagcagatctggtcgaatgccagagccgacggtcacagtccggatgagagaagatgtgcagatagtcatgtccgccagggccgcttcgccacgtgcgcgaagcgggttgtcgttctgtctgtttgcaatgccctgaaacgtttttcgcccaaaccgtatttgcgaggagcgtttcacatgtcctgatgtccgtttcgtcggcacctgccgacgcctttgccgatctcccgttgctggattccgaaccggtgccgccgcgcatcgccgccgcgctcgatgcgatgcgcgcaggccgtgcggtcgtgctgcaggacgaccacgaccgcgagaacgaagccgacctgatcgttgccgccgagcgcatcacgcccgagacgatggcgctgctgatccgcgagtgcagtggcatcgtgtgcctgtgcctgaccgacgacacggtgcgcgcgctcgagctgccgccgatggtgcagaccaacgagagccgcaacggcaccgcgttcaccgtctcgatcgaagcacgcgaaggcgtgcatacgggcgtatcggcggccgatcgcgtgacgacgatccgcgcggcgatcgccgaaggggcgaagccgcatgacatcgtgcgccccggccacgtgtttccgttgcgcgcgcagccgggcggcgtgctcgcacgccgcggtcacaccgaaggcacggtcgacctgtcgatcctcgcgggcctgaagccggccggcgtgttgtgcgagctgatgaatcccgacggcacgatgacgcgcggcgacgatgtcgagcgtttcgcgcaacggcacgggctgccgatgctgacgatcgcggaactcgtcgagttccgcgaggcgctggccgccgcgcgcgagcgctgctgcgaaccggcctgagtgaagggaagggaaagcgggcgcgttcatgcgctcgtggcacggcgtgcgtgaagcggcgcacgccggacaggcccggtcagcctgatcgggcctgaacgaccgtcaggactgtacgtccccgaattcgccgcgcatgccggcttcgacgaacgccggcagctcgtccatcctgcgcatgatccgcgtgatgcccatcgcgcgcagcgcgtccgcgtagttgtcggggatgtggctcgcgccgacgaacgcgatcgtcttcatgcccgccgcacgcgcggcattcagcccggacacgctgtcttcgacgacgatgcagcgcgccggcgcgacgccgagcgtttgcgccgcatgcaggtagacgtcggggtagggcttcggccgcggcacctgctcggagctgaacacgcgatcgccgaagatctcggtgagcgatgcgcgcttcagcgagctgcgcacgcgcgcgagccggctgttcgacacgacggccgccggcaggctcacctgcagcagcgcgtcgcgcacgccggtgatcggcgcgagcgattgcgccagcgcgctctcgatgttgtgctcgatcgtttcgatgaagttggcgggcatctcgatcccgaagcgggattcgatcccggtcaggaagcgcgacgtctgctggccgaacgccgacttcgcggcggcttcgaaatcgatgttcgggaacgtggaggacagcgtatcgagcagcacgcggtcggcgatgacttcgctgtcgacgagcacgccgtcgcagtcgcagatgaggtgatcgagcatggtggtgaagaagcggaatgtcggcgacgcagatcaattcgccatcatacgtgctttcacgcgcatgccgcgagacgcttcggcaagttttcccgatgccgtgcgcggattcggccgcgcggcggattcgtcgaggaaatgcgcgtggcgggcatgctggtcgaatgcgggagcgacgtgaacccggcggccgtggtggacgcgggcgtgaagcggaagtcgccggtgtcgcccggggcgaccagtagcgcgaacgtggcggggaggcgcgaagaaaggagcatgaagcgcgcggcggtggcggccgcgcgcttcggtcaggtcgagatcaggccatcgcgtgcaggtgcaggtacaggccggccgccgcggcgccgcccagcagcgggccgacgacgggcacccacgcatagcgccagtcgctgtcgcgcttgccggggatcggcagcagcgcgtgcatgatgcgcggcgacaggtcgcgcgcggggctcatcgcatagccggtcgggccgccgagcgaaatgccgatgccgagcacgagcaggccgacgggcagcgcgtcgagcgcgccgaggccgacctgcggcgacgcgaggtacagcacgccgaggatcagcacgaacgtgcagatcgcttcggtcagcacgttgtgcgtgacgctgcggatcgcgggcgccgtgcagaacaccgcgagtttcaggtctgcatcggcttccttcgcgaagtgctggcgatacgcgagccacacgagcagggcgcccgccatcccgccgagcatctgcgcgaggatgtagccgccgactttcgaccacgcgaacttgcccgcgagcgcgagactgatggtgacgatcgggttcaggtgcgcgccgctgaacgacgcggtcacgtagacggcgacgaatacggccatcgcccagcccatcacgatcacgatcaggtccgcgcctttgcccttggtctttgcaagcagcacgtttgcgaccgcgccgttgccgagcagcacgaggatcgctgtgccgatgaactctgcaatataaggtgacatggttgtctctcgtatgtcatcgcggactcgcgctagcgcggtccgccggtgttgttgtatttcgtccggatggctgacgattactgggtatcgtcggcccacgccttcgcggcgcgtaccgcgcgctgccagccggccatgcagctttcgacctgctccttcggcatcgacggcgagaagcggcgatcgagctgccactggctgcgcacttcgtcgaggttcttccagtagccgatcgcgaggcccgcgaggtaggccgcgccgagcgcggtcgtctcggtgatctgcggacgcaccgcgtcgacgccgagcaggtcggcctggaactgcatcagcaggtcgttcgcgctcgcgccgccgtcgacgcgcagctcgccgatgctgatgcccgaatcggcttccatcgcggccagcacgtcgagcgactggtacgcgatcgaatcgagcgccgcccgtgcgaggtgcgcggaggtcgtgccgcgcgtgacgccgaacaccgagccgcgcgcccgtgcgttccagtgcggcgcgccgaggccggcgaacgcgggcaccaggtagacgccgtcggtgtgcggcacgctcgcggcgagcgcctcgatttcggcggccgacttgatgatgccgacgccgtcgcgcagccactgcaccaccgcgcccgcgatgaagatgctgccttccagcgcgtactgcacgttgtcgccgatctgccaggcgatcgtcgtgacgaggttgttcttcgattcgatcggcttgtcgccggtgttcatcatcaggaagcagccggtgccgtaggtgttcttcaccatgccggactgcgtgcacatctggccgaacagcgccgcctgctggtcgcccgcgatgcccgcgagcgggatcttcgacgcgaacacggtggttttcgtgtgaccgtagatttccgacgatgccttcacgtccggcagcatgctgcgcgggatgtcgagcagctcgagcagttcgctgtcccactcgcgcgtgtggatgttgaacagcatcgtgcgcgacgcgttcgtcacgtcggtcacatgcagttcatgcttcgtgaagttccacacgagccaactgtcgacggtaccgaatgcgagcttgccctgcctggccttctcgcgtgcgcccggcacgttgtcgaggatccagcggattttggtcccggagaagtacgagtcgatcggcaggccggtcttcgcgcgcaccttcgcctcgaggccctgtgctttcagcgaatcgcagaagtcggccgtgcggcgatcctgccagacgatcgcgttgtagacgggctggccggtctcgcgatcccagacgatcgtggtttcgcgctggttggtgatgccgatcgcggcgatcgacgtgccgttcaggcccgtgcgcgtgacggcttcggcggcgacgccggcttgcgtcgaccagatttcctgcgggtcgtgctcgacccagccgggttgcgggtagatctgctcgaattccttctgggcgatcgatacgatattgccctggcgatcgaacagcatcgcgcgggaactcgtggtgccctggtcaagcgcgaggatgtactgatcctgcatgtctctcatctccatccgtggatttggcttagttgtgatgcgcgccgcatgtggggcggcgcgtcggtgagtcaacgtcggtacggcaactgctactgcattcgggtcaggcctgcggcgcgtgcgcggcggcgaaccacgcgtcgaccgcggccgtcaccgcgtcgagcgtgcccggcgcgacgtgcaggccgagcttcgagcggcgccacagcacgtcctgcgcgcaggtcgcccattcggtgtcgcgcaggtagcgcagctcggcgtcgtggatgcccggggcgatttcggtgccgagatcggcgagcgacttcgcgccgtcgatcacgcgctccgcgcgcgtgccgtatgcacgtgcgtagcggcgggcgagcgcggcgggcagccacgggtggcgtttcgcgaacgcggcggcgaacacgtcgaacttcgcgttcgcgatgtcgccgcccggcagcgcgacgccggccgtccaggtcttcgcgtcgcggccgagcgcgcggctcagcatgtcgccggcttcttccgcgagcttgcggaacgtcgtgatcttgccgccgaacaccgacagcagcggcgcacccgcgccttcgtccatttcgaggcggtagtcgcgcgtgacggccgatgcgttcgcggcgttctcgtcttccagcagcgggcgcacgcccgagtaggtccagtgcacgtcggccggcgagatcttgcgcttgaagtagcggttgatcgaatcgcacaggtactgcgtctcgtcgcgatcgatcgcgaccttcgcgggatcgctcgtgtattcgacgtcggtcgtgccgatcagcgtgaaatcgtgttcgtacggaatcgcgaagatgatccgcttgtccgggttctggaagatgtacgcgtgatcgtgatcgaacaggcggcgcgtgacgatgtggctgcccttcacgagccgcacgctgtgatgcgcgccgcggccgagcgcgccgtgcagcagttcgccgacccacgggccggccgcgttcgcgatcgcgcgcgcatgcacgacgcggatcgaaccgtcggcgttctgcaaccgcgcttcccattcgtcgccgcgacgttcggcggataccagcttcgtgcgcgtcaggatctcggcgccgcgctccttcgcgtccagcgcgttcagcacgacgaggcgcgcgtcgtcgacccagccgtccgaatagacgaaaccgcgcttgatcgaatcgatcagcggcgcgccggccgcatggcggcgcatgtcgatgccgcgcgagccgggcagcagttcgcgttttgcgaggtgatcgtagaggaacaggccgagacggatcagccaggccggacgcaggttcggcatgtgcggcatcacgaaacgcagcggccccatgatgtgcggcgccgcgcgcagcagcgtctcgcgctcctgcagcgccttgcgcacgagcccgaactcgttgtactcgaggtagcgcaggccgccgtgaatcagcttcgtgctgcacgacgacgtgtgcgacgcgagatcgtcctgctcgcagagcaggaccgacaggccgcggccggccgcatcgcgcgcgatgcccgcgccgttgatgccgccgccgacgacgagcagatcgtagcgattcggttgggtcacctgctgtccttatcgtctgagggaaatggttgaacagaaaatgttcgaattcgaaatttaacgaacgaaatcgaaaaagtaaagttcgataaagcggggccagtagcgcgccgtgcgatcccggacgatactggcggaatcgaccgtttcgcgaggtgaatcatgcgtattgggatgtgggccggcgtgtgcgccgtccttctggcggggtgcagtgccggtatgccgccgctcgtcggcaactggcgcacgccgtcgttcgtcgacctgcagacgtcgtgcggcggcgcggcgcgcgactggggcgcggacgcgcagccggtctattcaacgctgtacgacgcgtacgtggcgaaacggtatcgcgggctgaccgaagcgaactattgtgcgttcgtaaacgaactttcgacgcactacgcggcgcccgacgcggcggcgcgtgccggctggatcgcgtatttcaacggcgcgcgcgcaggccatcagctggcgggcggcggtcgatccgacgctgcgcggcggctgacgcaggtgggggcgacgaggcggggaagcgaggaagcaggaacggccgcgcggcccggaatccgggccgcgcggtcaggtcggcaacggtggttttacgaatagcggtatttgatggatcgcagcgcggcgtcgccggtttcggtcacgcagtatttgcgccccgatccgagcccttccaggcggacgagctgctgttcgagcagtgcgtcgatttcgtcccgatccatcgaggtttgatcgggagcgtccttcacaagcaatagcgtggcgaattcatgcggactcagcatcgttctctccatggcgaccagtcagcccgcgcggccggcgcacctgccgacgcgcgatacccagcggggtatggtttgggggaaaagctgcattcgccggccatgccattcgtccgcgccctggcacaggcggaacggtcggacgggccggggaactggagtctagtcgagcatgcgggcaaccacaaatcgtgccccgttaattttccgtttgacagccgggccccgcgcaagcggtttgctcgcagcgccaacttcttgatttcacttgaagtttcaggtgcggtgcagcatcccggccgtcactccgcgacgtacacctgcgtgccggcggtcgccaccgcgtcggccatttccggcggcagcggcttgtcggtgaagagtgcgtgcacctggctcaggtggccctggcgcaccagcgccgggcggccgaccttcgaatggtcggcgacgaggtagaccgtgcgcgcatgctgcatgatcgcctcggccacacgcacctcgcgcgtgtcgaagtcgcgcagcgtgccgtcggcctcgatcgccgacgtgccgatgatcgcatagtcgaccttgaactggcggatgaagtcgatcgcgagctcgccgacgatccccttgtcccacggccgcacgatgccgcccgtgatcagcacctcgcagtcggggtagccgctcatcatcgacgcgacgttcaggttgttcgtgatcacgtgcagcccgtggtggcggttcagcgcgcgtgcgacttcctcggtggtcgtgccgaggttgatgaacagcgacgcctggtcgggaatgtgcgacgccgcgagcgccgcgatgcgccgcttctcgtcatggaacatccgctggcgcgccgtgtacgacacgttctccgagctggtcggcaggctcgcgccgccgtgatagcggcgcagcaggttcaggtcggcgagccagttcacgtcgcggcggatcgtctgcggcgtcaccgcgaagtgcgcggcgagatcgtcgacggtcacgaagccgtcgcgctgcacccattcgagcagttcctgctggcgcgcgttgagggtgaggcggggatctcgggtcatggctcggtggtcgtgtcgtgagacggagcgggtattgtaagggcggcaacgccgttaggccggtatggccggcaggggcgcctgcaattcatgcggaaattgcattgattcatgtgacaaatgaatttgtgcgattgcgctgatcgcgctgcaatggcggactgcccgcgcgcgggtgcgcgcccggcgcttcattcagctttcgacgaggtggaaccgatgactggcttcaactggcacaacccgtatccgacgacacgcattccggtgttcgcgcgcaacgtcgtgtcgacgtcgcacccgctcgccgcgcaggccgggctccggatgctgtggaagggcggcaacgcggtcgacgcggcgctggccgccgcggctgcgatcacggtcgtcgagcccgtgtcgtgcgggctcggcggcgacgcgttcgcgctcgtgtgggacggcgagcggctgtccgggctgaacgcgtcgggcgtcgcgccggctgcgtggaacgtcgactatttccgccagcgccacggcgaggcggcgaacggcatcgcgaacaagccgacgcgcggctgggacaccgtcaccgtaccgggcgtgatcgcgggctgggaagcgctgcatgcgaagttcggttcgctgccgttcgcggacctgctcgagccggcgatcgagatcgcggagcgcggttatgcggtgcctccgatcgtcgcgcacaagtgggcggccgccgtgcccgagctgcaggggttgccgggcttcgcggagaccttcatgccgcgcggccgcgcgccgctcgtcggcgagcgcgtgtgcctgcccggtcacgcgcagacgctgcgcacgctcgcgaaggagggcccgcgcgttctacgagggcgcgctcgccgagcgcatcgccgcgttctcgcgcgaaggcggcggcgcgctgaccgcggccgacctgcaagcgtaccggccggaatgggtcgagccgatcggcaagcgcttcggccgtcacacgatccacgagattccgccgaacgggcagggcatcgccgcgctgatcgcgctcgggatcgccgagcacgcgggcgtgacggaatggccggtcgattcggtcgactcgcagcatctgcagatcgaggcgatgaagctcgcgttcgcggatgtctatcgctacgtcgccgatccgcgcgcgatggaggtcacgcccgaacagatgctcgacgacgcgtatctcgccgaacgcgcgaagctgatcgatcccgcgcgcgcgacgcacttcggcgccggccggccgcattcgggcggcacgatctacctgtcggcggccgacgaacgcgggatgatggtgagcttcatccagtcgaactacatgggcttcggttcggggctcgtcgtgcccggcaccggcatcgcgctgcagaatcgcgggcacggcttctcgatggacccggcgtcgccgaacgtcgtcgcgggcggcaagcggccgttccacacgatcatcccggcgttcgtcaccgaggaggccgacggccgcacgcaagccgtgatgagcttcggcgtgatgggcggcgacatgcagccgcaggggcacctgcagaccgtcgtgcggatgctcggctacgggcagcaaccgcaggccgcctgcgatgcgccgcgctggaaggtcaaccgcgacttcacgctcgacgtcgaggccacgatgaatcgcgcgaccgtcgatgcgctggccgcgcgcggccatacgatcaagtcgatcgacgatccttacatggatttcggttccgggcagttcatctggcgtctcgaccgcgacgatcgcgagcgcggctacgtggccgcgagcgacagccggcgcgacggcctggcggcaggtttctgacggattgcggccggctttcaccggcatttccagcgcttcacgggcggccggacggccgcccgtttcgtttgccgcggcccgtatcgtcgagcgggcgcaagcggtttgaaggactcgtctaacgaacggcaacagatgtcgtggaactgcgcttgtcaggtatggtcagtgctctggagcacgaacgtcaaagtccggctaagatgccagcatggttcggccggaccaatccactataaacgcaagtaaaacgccgcctgcgggtcggtcggcgcctgtgccgaaggcatgggccggcgcccgtgcgacgactgggagcgcaccaccatggacaccaaaacgacgcatgtgatgccgtggcgcatcgaggacatcgacctgaaccggatcgatcgtcagcgtgccgccgcgaacgaggatctgttgctgctgctgtgcgcgtcgtcgttcatcgaaagcggttcggatctctacacgagcaatctgagccagttcttcaacgacgatccggaagtctccgcatggctcaacaatgcatgggagcacgaagaattgcagcacgggcgcgcgctgaaggcgtacatcgcgcacgtgtggcccgagttcgactgggataccgcgttcgcgaatttcttcgccgagtattcgttgacctgcaaggtcgaggcattcgagaagacccgcgcgctcgagatggtcgcgcgctgtgtcgtcgagacgggcacggccacgctctatcgcgcgatcaacgaatgctcggacgaacccgtgctgaaggaaatcaccgacaacatccgcacggacgaagtgcgtcactacaagcacttcttcaagttcttcaagaagtacaaccagctcgaaggcaacggccggctcgcggtgctcggcgcgctcgcgcgccgcgtgatggaaatcaagaacgaggattccgagatcgcgctgcgccacgtgttcgcggtccgctatccggatcgtgtcggcgacagccagtacaaccgcgagcgcgccgcgcgcatcagcaagctggtgcggcgcaacctgtcggccgacatgtgcgtgaagatgctgctcaagccgctcgacctgcccgcgaagatccagccgggcgtccactatccgctcacgaagatcacgcggcacgtgttcctgcgctgatcgccgcggcgcggcccgtcgcgcgtatgctgcggcttgttcatccgctttccacccggggccacgccatcatgaccgatacccatcgccacgcgctcgaacaatggacgttcgatgcgtggccgccggccgtcgtctcgctgttcgacggcacggcgctcgagcgtcatgccgacttcgccgcatcgctgatcgtcgcgaccgacgacggccagttgcgcacgacgctgctcggcgtcggcgagatctatgcacacgatgcgcgcacgctgctgcttgcgctctggccgcaatcgcgtgcggcgcgcgcgatcgcgcaacggcgcacggccgcgctgacgctcgtcgcagacggcgcgttctttcaggcgcaattgacgatggagccgctcgaaggggacttcggcgggctggccggattcgctgcgacgatcgcgcacggcgatgcgcagcgggtcggctatgcgcgtctcgcgacaggcgtcacgttcacgctggaagggagcgcgccgcggtgctcgagcgctggcaacgccaggtcgagcacctgcggcgcgcggccgcgcggcttcagtgaccgcgctggccgctgcgcgacgaacggttgcggttcgggtgcgcggtgttgccgttcgcggggcgtgcgccattgccgccgcccgccgggcgtccgccgctgccgccggcgccgccttgcgtgcgcggcttcgcggccttctgctgcgatgctttcggctgtgcgttgccgtcgcgtttcgcggccgccggctggcctgagccgctcgcacgcggctggcgattgccgccaccgccgccaccgccgcgcggctgttgttgcccgcggcgctgctggatcggctccggcttcgcgttcggatcgggttcgaagcccgcgatcacttcctgcggaatctcgcgcttgatcagccgctcgatgtcgcgcagcagctgcttttcgtcgacgcacacgagcgacacggcttcgccggtcgcacccgcgcggcccgtgcggccgatccggtgcacgtagtcttccggcacgttcggcaggtcgaagttgacgacgtgcggcaactggtcgatgtcgatcccgcgcgcggcgatatcggtcgcgacgagcacctgcagcgtgctgttcttgaactccgccagcgcgcgcgtgcgggccgactggctcttgttgccgtggatcgccatcgcgctgatgccgtccttcgtcagctgctcggcaagccggttcgcgccgtgcttcgtgcgcgtgaacacgagcacctggaaccagttgtgttcgcggatcaggtgcgtgagcagttcgcgcttgcggtcgcggtcgaccgggtggatcttctgcgcgacgctctcggcggtcgtgttgcggcgtgcgacctcgatcagcgcgggcgagtcgagcaggctgtcggcgagcgccttgatctcgtcggagaacgtggccgagaacagcaggttctggcgctgcggcggcagcttcgcgagcacgcgcttgatgtcgtggatgaagcccatgtcgagcatccggtcggcttcgtcgagcacgaggatgtcgaggtccgacaggtcgatcgtcttctgctgcatgtgatcgagcaggcggcccggcgtcgcgacgacgatgtcgacaccgcgcttgagcgcgtcgatctgcggattgatgctgacgccgccgaacatcacggtcgagcgcagcttcaggtacttgctgtaggcacggacgctttcctcgacctgggcggcgagttcgcgcgtcggcgtgaggatcagcgcgcgcaccgcgcgcttcgcgccgcgatgctcggcgtagaacgtgtgcaggcgctgcaggatcggcagcgtgaagcctgccgtcttgccggtgcccgtctgcgcaccggcgagcaggtcgccgccgccgaggacggcagggatcgcctgctgctggatgggagtcggcgacgtatagccgagctcgttgaccgccttgacgagcggttcggccaggccgagagattcgaaagacatagataccactcttcagttttatgatcggcgacgtctcgcgcggcccgcgcgggaggtgacatcgcaaattgcaaaatgcaaagggcgcggccgcggtttcccgcagccgcgccccgtgtttgtcagccgcttcttagtcgagcggcgcggaacgcaggtcgctcacctgttgcggtgagatcggcgtaccgttgttgccccacgacatccggatatacgtgacgaccgccgcaacctcctggttcgacagcgactgtgcgaacggcggcatcccgtacggacgcggattcttgaacgtgctcggcggatagccaccgttgagcaccatgcggatcgggttgaccgccgattccatcacgatcgagtggttgcccgcgagcggcggataggccggcggcttgcccgcgccggtttcggcgtggcaggtcgcgcagttgtccgcgtagatcttcttgccctggtcgaacagcgcgttgccgaactgcttcgacggctcgtactgcatgttcttcggcgcttcagccttctgcgggatcgacttcaggtacgtcgacatcgcgcgcgtatcttcgtcgctcatgtactgcaggctgttgtgcacgacgtcggccatcgggccgaacaccgcgcccttgttcgacacgccggcttgcagcaggtcggacagctcctgcacgtgccagtcgccgaggccgagttccttgtcgttcgtcagcgacggcgcataccagttctgcagcgggatcaggccgcccgcgaaggctgccgagctcaccgggccgcccatcatgttgatcgacgtgtggcacatcgagcagtggccgaggccctcgacgaggtacgcaccgcggttccattcgaccgacttggtcggatccggcttgtactcgccttccttgaagaacagcgtgcgccagccgatcagcaggttgcggttgttgaacgggaacttcagttcgtgcggacggctcggcaccgacaccggcgcgaccgagcgcaggtacgcgtagatcgcgtcggaatccgcgcgcgtgaccttcgtgtagctcgcgaacgggaagcccgggtagagcaggctgccgtccttcgaacggccggtgtgcatcgcgcggtagaagtcgtccgacgtccacttgccgatgccgtccttgtcgtccggcgtgatgttcggcgtgtacatcgtgccgaacggcgtcgccatcggcaggccgcccgcgaacgacttgccgccgcgcacggtgtggcacgcgatacagtcgccgacgcgcgcgaggtactcgcccttcttgatcagcgcggcctggtcggccggcgtggccgcgacggcggcagcgccgtgcagcgtgtcgttgcccggccacaggaccggcacgagggcggcggccgcgacgatcgcgacagccgagagtgcaaacagggacttgcgtttcattgtgtctgtctcccttgccttattgcggttcgctgccgcaggcgagcggagtcttcatcgaacgcgccggagccggcacggggttggcgggcgccggttgcgcggcgagccatgcggtcacggccgtcacgtcttcgtcggaaagcttcgaagcgacttcatgcatgcaatcgggcgccttcgcgtggcggttgcccgagcgccatgcaccgatctgcgcgctcaggtagtcggcgtgcaggccgaccaggcccgggatcgccggctgcatgccggtgagcgtcgcgccgtggcaggccacgcaggccggcagcttgcgggacgggtcgccttgcgtgacgagctgcttgccgcgcgcgagcgtcgcggccggcagcgtcggcttcgccggcgtcgggtacggcgggcgttcggccgagaagtgctcggccatctcgcgcaggtagtcgtcgttcaggtacgtcagcaggtagttcatcggcgggtacttgcgccggccgtcacggaagttgacgagctggttgtacaggtactcggccggcttgccggcaagacgcggaagtagtcgttgtccgtaccctggccatggacgccatggcaggccgtacagccgcgcacgcgctcggccatggtatcgggtgccttgagcggcgcctgctgggcgtgcgcttgctccgtgggcttggtctgcgcttgggcagcgctcataaggcccgcgccgccgaacatcagaacggcgagcagcggacggaagaggcgtcttgaagacacacgagactccatgtttattcgacggggacctgtccgggctacgatcggctcggcgcatgacggcaaggcagccgggctgctgcgacgcggcattctatcatcgatgggtaatgacggctatttggcaaaaggacatcggttcctgtccgtttgcgacttgcgacaatttgacgcgcattgcgccgcacctgtgtgaaccggcgtgcgttttcaccatcgaagaccgtacactcgcgggtcgcgcggcgccgcctccgccgcaggtccagtcatttctcccgtttccggattcatcgatgacgttttctaccgtgccgttgccttcctcacgctgtccgtcccgttgccgcttcgtcggcctgccgctttcgggagggtgtgcgcgatgaagttcgacagcttgtggatcggtcaggtcgcgctcgcggcgctgatggacgccgcgttcgcgatggcggtcggctcggcgctgctcaaggcatggctcggcaaggacggtgcacgtccggtcgtcgcgccgtcgcaccccgcatggctgcgcgcgcaacattcgctggccgcggcggcgctggcgctggtgctcgcggatctcggctggctcgtctacgaggccgcgacgatgagcggcgcggggctcggcggcgcgttcgccgcgattcccgtgatgctgacgcagacccatacgggcttcgcatggagcgtcgcgttcgccggcgccgtggtgctcgcgatcgtcgcgctggcgaagccggaaggtccggccgcgcacgcggtgctgtggctcgcggtgatcgtggtcgcggccggcaaggcctcgctcggccatgcggccgatacgggcgcgctgtccgcggcggtcggcgtgcagacgctgcacctgctcgcgaccgccgtgtggggcggcctcgtgctcgcgggcgggctcgcggtgctgccggcgctcgggtcgtcggtcgcgcgcggcgcgctgatccgcatcggccagcacctgtcgcgtacgtcgatcgtcgcggtcgtgttcgtgctcggcaccggcacgctcaatgcgatccgcgggctcggcggctcgcttgcgccgctcgacggcagcacgtgggggcgcgtgttgctgctgaagctgctgctcgtcgcgctcgcgctcgtgctcggcggcctgaaccgtttctcggcgctgccgcgcctgcgccgcaccgcgtcgaccgaggatgcgcacacgttccgcaacatcctgcatctcgaggcgctgacgatgatcggcgtgttcgtcgcggccgcggtgctgtcgttcagcgtgccggggttcgcggcgctcggctgacggccggttgcgcgcggcgcgacgcaaggccgccgatgcgcatccgccatgtgcatccgccacgtgcattcgccacgtgcattcgccacgtgcattcgccacgtgcattcgccacgtgcattcgccacgtgcatccgccatgtgccgggcgccgcgccgggcatgcaaaaacggctgtctgtcgggcagccgttctcgtatcgatacttgtcgcgacacagcgcgactggccgcgcacgtcgcgcatcgcgctcaccactcggcgacgctgccgtccgcgtgtcgccataccgggttgcgccagcggtggcccgtcttcgccatctcgcgcaccttctcctcgttcacgtcgatgccgagccccgggccctgcgggatcgcgacgaagccgtcctcgtagcggaacacctcgggattgcgtaggtagtcgagcaggtcgttgccctggttgtagtggatgccgaggctctgctcctggatgaacgcgttgtagctgaccgcgtcgagctgcaggcacgcggcgagcgcgatcgggccgagcgggcagtgcagcgcgagcgcgacgtcgtagctctccgcgagcgtcgcgatcttgcggcactcggtgatgccgcccgcatgcgacgcgtcgggctggatgatgtcgacgtagccgcccgcgaggatgtgcttgaagtcccagcgcgagtagagccgctcgccgagcgcgatcggcgtgttggtctggttgacgatgtcgcgcagtgcctcggcgttctccgacagcaccggctcctcgatgaacatcagcttgtacgggtcgagctccttcgcgagcaccttggccatcggcttgtgcacgcggccatggaagtcgacgccgattccgacgtgcgggccgaccgcgtcgcgcacggccgcgacgttcgcaatcacctgctcgaccttgtcgtaggtgtcgacgatctgcagctcctcggagccgttcatcttcacggccttgaagccgcgctcgaccaccgcgcgcgcattgttcgcgacgtcgctcggccggtcgccgccgatccacgaatacaccttgatgcgatcgcgcacctggccgccgagcagcgcatgcaccggcacgccgtgatgcttgcccttgatgtcccacagcgcctggtcgacgcccgcgatcgcgctcatcatgatcgggccgccgcggtagaagcccgcgcggtacatcacctgccagtgatcctcgatcagcagcgggtcgcggccgacgaggtagtcggccagctcctgcacggcggcctcgaccgtgtgcgcgcggccttcgacgacaggctcgccccagccgacgacgccctcgtcggtttcgatcttgaggaacagccagcgcggcgggacgacgaaggtttcgaggcgggtgattttcacgatgcgtgtctccaggattgaccggcgcgggcagtcgggcgccgcgcgcggtcgcgtgctttcgcggttatcctagcgcaggccgataaaaatagtattaatagcactattgtgcagatagtgggcagccggtacacccgggcaccggcataacggagaacgatcattcgacgcgacctgcatggacagacggccttccggctcgccacggcgatcctgcgcggcgactacccgcccgagtcgctgctgccgagggaacccgacctgatggagatgtacggcgtgagccgcacggtgatgcgcgaggcgttgcgcacgctcacgtcgaaggggctcgtcgagtcgcggccgaagatcggcacgcgcgtgcggccgcgcggcgtatggaacctgctcgacgccgacctgctcgactggtatgcgcgcgtcgcgccgccgctcgcatttgcgctgaagctgcaggagatgcgcgagatggtcgagccatacgcggccgcgctcgccgcgcgcatgcatacaccggaaacgttcgacgcgatcgacggcgcggcgtgcgcgatggccgccgcgcgcaacgtcgacgaatgggtgcgcgccgacctgcgctttcacctgagcgtgctcgaggccggcggcaacgagctgctggtgccgctcggcacgctgatcgatcgcacgctcgaggcgcagttgcacctgaatgcgcgccgcgcggacgtgtacaacgcgtcgctcgccgagcacacggcggtcagcgacgcgatccgcgtgcgcgacgaggacggtgcgcgccgcgcgatggcggcgctgctcgcggtgacgcgcgcgcggatcgagatgtcgtgacgcgaaacggcgggcggcgcggtcaggcgttcgcgcagccgcccggcttgtggatgcgcgcgatggtcgcgatcaacgtgcgctgtctcgaaggcgtcgatctcgacgcgctgccggtcacgcactacgacagccgctcgcactgagcgaagcgtcggcgcatgacaggacgcgcggccgtcaggacggttgcgcggccgcggcacctgtcgcgggcgctgccgcgtgcggtgcggcgcccgcggtgcgcgtgccggtgccggccgggcgttcgatcagcggcgcgagcgccggcgccatcgacttcagcaactgcacggccatcgcactcgtgaagtcatagcgtgccgcgtacggttcgtgcgcggtcgccgtcaggaccccgaagaaccggtcgccgagcacgaacacgaacgtgccgctgcggttcaccttgcgcgactcgatcagccgcgcgccgcgcgcgtagacgttgaagcgctggtcgcctgtcccggtcttgccgtacacgtcgagcgtcttgccgtcgggcagcgtgaagccgcccgcgaggcggcgcgcggtgccgttgagcacgacgtcgcgcagcagcgtgtgcgcgacgttgacgatctcgggcgacagcaccggttgcggctgcgcggccgcgcgcacgaagcgcgtttcgtacggcgtgcccttcgcgaagtcgagccgcgtgatcgtctcggtcggcgctttctggccgccgttcgcgatcaggccgatcagtttcgcgagcgcgtcgggctggtcgcccgatgcgccgatcgcggccgcgtacgacggcgtgacttccgcgaacgggtagccgagtgcccgccacgacttcgtgatctccgcgtacgcgcgcagttcgaccatgcgacggatgcggcggtcctgggtcgcgtggtagcgcgtcttgtacagccacgagtacgtgtagaaacgcgcgtcgcggctgtcgcgctggacatcggcaagcggcgccgccgggtgggcgcgcaggtagttgagcgtccacagcgcgagcggatgcacgctcgcgatataaccgcgatcgttgaggttgaagcggtcgatcgcgtacttcgcgtaaagcctggcgagatcgtcgtcggacagcgtcgcggccggcgtgcccttcagttgcgcgcgcatctgcgcgtcgaaccacgcgagcgattcgttcggcgcgacgctgcgcagcaccgtcgcgatcttcggcggcgacttgcgcacgtccttcagcatcagcgcgagcgcgtcgtcgggcgccttgcccgcatagcgcgtgtagtagcgcttcacgtagacctggctttcgccgtcgacgaactgctgcaggtagtgccggcgctgttcggggtcgccgagccacgacgacgacgggccggccgcctgcagcgtctcgtagtggacgatgtcgcgcatcagccgcacgaacacgaggttgaccgagtgctcgaaggccgcgtgcagcgtcaggatgcggccgttgtccgacttttcgaagttcgagaacacctgtgcgccgccgcccgtgtagaacacgtcagggctcgccgaatacttgcgttcgacggatgcgtcgagcatagcctgcagcgagcggtcgcgtgtatgcgacaggtagtcgagcgcccagtgcgacagcccgtcgatcgggtcgggcttcacgcgggccagctccgcgttcgacaggttcgcgtagcgcgcatgcaggtcggacacgatctgcaggtaggtgatcagcgtgcgcagcttcgcggtcgagccgaggttgatgcggccgccgcgattgacgtcgaacggctcgttcacgctgtcggtctgcacgcgcagcaggttcgcgccgttgcggtgttcgtacagcgtgaagctgtacgtgaggtgcgacgggtcgtccttcggtgcgagcatctcgaaaccgtacaggccggccgcctgcgcgccgtcgcgcgtcgacgcccgtgcgagccgctcggcgacggcctgctgcacgccgttgtcgagcgtgctggtcgcctgcaggtcgaactggtcgagctggtacaggtcgctgatgccgagcgccgacagcagcgacgcgcgcgcggacgtcacggccttgcgcgacacgaacgactgcacgtgcgcggcggccggcggcgcgctgcgttcgatctgcgcagcaagcgcggcgtcgcgcagcgccggcgagatcacgccgccgttcgacagcagcctcaggtagctgtcggtcagccgttccagggccggatagccgcgattgaggaagtacgacggcgcgcgctgcgcgatgatcagcgacagcacctcgcggaacgccttgccttgttcgtcgacgttgtcgcccgtcgtcggcgcggacaggatgcggttcacgtcgttgaagtcgcggccgtaccacgcggcgaggccgtcgccgatgccggtgatctcgccgatgtgcggccgcgcggcgagcgggacggaattcaggtagcgcacgacgatggtgcggcgcgcgagcatcgtctgcgggccgttcaggtacgcacgcaccgacgccgacgcgatctgccgcagcttctcgggcggcgtcgcggtgcggccctcgggcgaatggcggaacttctcgatctgcgtcgcgagcgtgctgccgcccgggcgcgcctggtggcggttgacgacgtgcagcgcctggtcggcgagcgcgcggctgaagcgccccagtcgatcgccgggttgcggttcggctcgttcgcgtcgagcaggtagcgatcctcgatgaacagcagcgaatcgacgatcacgcgcggcaccccgtcgaagtcggcatagacgcgctgcgggaacacggtcgcgaacagcggcgcgccggtcgagtcgaacagcgtcaggcccgcctggtccttctcctcgaacgggaggaacagtccgcgatcgccgatcgacagcatccgctgcgaatcgcgcgcctgcttgccgacgacgaagccgcgcgcgagcagccgttcctggaacgccggaatcatcgcgtagccgaggcgctggtcgtacgggccgttcgcggggaagcggatgcgatcgctcgggcccgcctcgagcgtgtagccgacgtcgcgggtgagatcggacaggtagtgcgcctgcagccgggacgtttcgatctcgctctgcacgagccgcgcgacgatcgccaccgcgatcagcagcgcggcgagcagggaccacttgacccacgtccagaccgatgcgggaccggtcacgcgcggcaggatacgattcagcggccgattcatggcggcgtctcctgaaggcgcgggctccggccgcaccccattaaggattagtgtagtcctccgcagcgggctgccaagggcgtcgactaccgagatgcgtcgacgcaacgtgcatgcctgtgatgcgcggcaacgggcgccgcgccgagatggtgcgcgccgctgcggcttaaacgtttgcgcgttgcgcgcggcgacgtcggcgtggcaggggcggcggcgggcaggcccgcgtggccgggtcgacggacgacgcacggatttcgtgcgctgcggcatcgttccaattcgggccggaacccgttcgtgaaaggggcgtcgcacggcgacgctacgggtttccgcgatagccgcgcgcgccggcggcgggtacgatcgccggatgtgcggcgcatgtccgcttccgcccggagtcccatggcgatccatcccgtcgcactcgtgtgcacggccatcctcgggctgctgctgttcgggctcgggttcgtcgtgtccgtcacgcgctttcgatgcaccatcgggtccgggtgtgcgtccgacccgacgaacgggttgcacaagatcgtgcgcgcgcacggcaacacggccgaatacgcgccgttcctcgcggtgctgtttctctatttcggcgcccacgatccggctcgcgcgatcctcgcgctgatcgtcgcgtcaaccgcgttccgctgcctgctggtcatcggattgctcgcgtggccgacgatggccaacccgaatcccgtgcgtttcatcggcgcgctcggcacgtatctgtgcggggccgcgctgtgcgtcgcgctgttcgtctgaacggcggcgcgaccgccacagcagcgtcgcgcgatcgtgccggcgcacggcttcgacgaagcagtggatcaggtagtcgcaggcaatcgtgttcagcgcatcgcggcgcgtgagcacgccgaccgacacggccggaatcgtctcctccacgtcgatcgcgaccatccgctcgcgaatccagtcgatttccatggagcgcttcggcacgcaagacacggtgtcggtgtgcaccgacagcgaaaacgccgcgctgaacgacgtgcattcgacgatcggctgcggcgcgttgggcaccgattcgatggggcacgcggtggttgccgcgatcaacggccccggcgcgtccgcgaacgaccgccagtgcgaggcgcggatcggtatccggcacaagttctgacgaatgcggcgatcggctagcggcggccgcgagcggtgatatgctcgcggcacgcccgcgatcgacgggcggattccgattgcccgcgtgcggccgtgatgccgcgctgcaccgcatttccgagggaagaaccgacacatgagccgcaaattcattctgaagggcgacacgaccgaccacggcggtgtcgtgctcgacgggatcgccaattcgtcgttcgacggacgtgaactcgcctatctcggcgcgtcggtgttctgcgccgcctgcaagtcgcccggcgtgatcgtgtccgacggcggcgagcggacgatgaccgtgatgggcaaggtcgtcgcgctcgaacacgacctgtgccagtgcctgtgcacgccgcagccgaagctgatcgcgtcgcaggccaccgggacgatcaccggatgaaacccgccgcgcggatgcgctcggcatccgcgcggcctcggcgcacggccaacgtccgtcagacgctgccttcggtttcgatcacgaggacgcgtgcttcgccgagcggatgcgcgacgtgctcggtgccggccgtcgcgtggaacacgtcacccgtttcgagcagcgtcgcgtgctcgacgcctgcttcccgataacgcatctcgacgcgaccgtcgagcaccgcgaacacttcctcgccgtcgttcacgtgccatcgatacggctggtcggtccagtgcaggcgaaccgtgatgccgcccaggttcgcgatgtcgagcgcgccccacgcacggtctgcggtgaacgcggcgctgcggacgatgttcatcgatatgttctccggcgcgagtgcgcgtcgtctttcagtcgtcgaggcaatttctacgtatccgcattcagcgcgacgtcgcgcgcagcgcctgttcgatcgtcgccttgcgcttcgcgaaaccggccgccgaacgttcggtgacgcgcttcacgacggctgccggcgcggtgtccggcgaaccggcgtcgaacggcggcgcgggcgcgtattcgagttgcagctggatcgcctgcgcttcctcgtcgccggccagttccgcggcgatcgtcaacgcgaagtcgatgccggccgtgacgccgccgcccgtgatcaggttgccgtcgcgcaccacgcgctcgcgcaccggcaccgcgccgagcggttcgagcagcgtgtggaacgcccagtgcgtcgtcgcgcgccgcccgcgcagcaggccggccacgccgagcagcagcgcgcccgtgcagaccgacgtcacgtagcgcgcggtggccgcgcgctgctgcacgaaggcgatcgtttcggcatcgagcagcagttcgttgatcccgatgccgcccggaatgcagatcacgtcgagcggcgggcaatcgtcgaacgtgcaggtcggcgcgagcgcgagcccgctgctcgacgcgacggtgtcgcgcgacttccagaccaggtggacggccgcgtcgggcagcgacgcgagcacgtcgtgcgggccggtgagatcgagttgctggacgcccgggaacacgagaaagccgatatgcagggtcatgcgaagactccggttggaagggggcgcaccgttgccggcgcgggatggacagatcgattctaggcgcgtagtgtttggcgaaattgccatatcacccacgttttcagccaatcgccatgcctgccgccccgcgttcgatcctggttctcgcgttccctcgtgcccagctgctcgacgtatcggggccgctgcaggtgtttgcgtccgtcaacgagctcgcgcaggagcgcggccagccggcaccctacgcgccgcgtgtcgtcgcggccgaggccgggcccgtcgagacgtcgtcgggtctcgtcgtgatggccgagtcgctgcgctcggccgcacgccatcccgatacgctgatcgtcgccggcggcaagggcgtgcatgcggcatcccgggatgcacggctggtgcgctgggtgcggcagcaggcggcgcgcacgcggcgcgtggcgtccgtctgcaccggcgcattcctgctcgccgaggccggcctgctcgacgggcgccgtgcggtcacgcactgggcgcgctgcgacgagttcgcggcgcgctatccgaacgtgcgcgtcgaatccgatccgatcttcatccgcgaaggcgcgtggacctcggccggcgtgacggccggcatcgatctcgcgctcgcgctggtcgaggaggacctggggcgggcgaccgcgctcgacgtcgcgcgcgaactcgtcgtgttcctgaagcgcccgggcggacaggcgcagttcagcacgatgctgtcgatgcagcgtaccgacgaccggttcggcgaactgcatgcgtggatggcggagcacctgacggccgacctgtcggtgcccgcgctggccgagcgcgcaagcatgagcgagcgcagcttcgtgcgccactaccgcgcgggcaccggccgcaccccgcgcgcgcggtcgagcagctccgcgtcgaggccgcgcagcgcctgctcggcgaaacggcgtggcccgtcaagcggatcgccgcgcgttgcggcttcggctccgaggagacgctgcgacgctgtttcgtgcgggtgctgggcgtgtcgccgcaaggctatcgcgagcgcttcgtgcgataacgcacggcgtgcgctgcgctcggggccggaacgatcgccgagtgaaactgaacgaaaatcgatcgctttccagtccgaaacgcagaaactattcgggatcagagaacaatggacgggggcttgtgccgtgcccgtcgcgcgctctattctgttccgttggcgattcgaaggggagcagcatggaccgaatccaggcaatggaagtttttacccgtgtggtcgacgcgaacagcttcacacgcgcggccgacacgctcgcgatgccgcgcgcgtcggtgacgaccatcattcagaacctcgaggcgctgctgggcgtgcgcctgatgcaccggacgacacgcaggctgtcgctcacgccggaaggcgcggcgtactacgagcattgcacgaagatcatctcggagatcgcggaggccgacgcgagtttccagacgggcaaccgcaagccgagcggtgtgctgcgtgtccacatgccgagttcgctcgggcggcgcatcgtgctgccgtcgctgtcgattttccggcagcgctatcccgacatcacgctcgaactggggctctccgaccgctacgtggatccggtcgaggagggcatcgactgcatgatccgggtcgggccgctcgaggattcgtcgatggtcgcgcggcggatcgggatgctgaagcgcgtgacctgcgcgtcgcccgattacctctcgcgtcacggcgagccgcacgagattgccgatctcgccgaccatcacgcggtgaatttccgtgcgagccacggcgcgcgtgcgattccgtgggtgttcatgatcgacggcaagccgttcgaggtgcggatgaacggaagcgtcacggtcaacgattcggatgcctacgtgacgtgcgggctcgaagggttcgggatgatccagccgacgctgttcatggtgctgccgaacctgctcgacggctcgctggtcgaggtgctgcctgactgcaatccgaagccgaagccgatttcgatcgtgtatccgcacaaccggcacctgtcgcagaaggtgcgtgtgttcgccgactgggtcgcggaggtgttcgaggcgacgccgtcgctggaaggtggggagaactggcgcgggcgggtgggggcgcaggcggcgaagctgcagcgagggcggtggcggcgtgaggcgccggggcgcggccggggtggccgtgccgccggtcaccgcggtgttggcgtcccggaaaagccgcgtgtcgatgccgcggtttcagttgcgggattgatccggaacagcgccttgcgtcgcgcgatcgcgcagcgcggcgggcaatttccacagcatcagttcgcgcgtgccgattgcccacagcgcagaaccgtcccacgaaaaggccagcgcctggatctcgctgtttttgggtagcgacgatgcgtcgagctgcacgggcgtgcggccctgtgcgacatcccagagtgccacgcgatgttgccagccgcccgctttgcaggtcgtacccatcgcaaggaagcgaccgtttgccgaacgggcggcggccttgaaggtgtcggcagcgcccagcagggccgacagtacgtgcccgttcttgagatccaccacatgcatgccgacgaagcgcgcccgtttcgggcccggggccttcacgggaggtggcatgctgccgtcgtcgtcgagcaacagctcgaagcctgtcgcgatccagtgaccttgcggcgagccgagcggcttgggcacccattgcgcggcgccggcggcgctgaaggaatccggtgtgccgatgcgccggggcaacgcgatcgtacgcagcgtgcggccggtgcgggcgtccagctcggcgagcccttgcgaatcctccgtccagtagctcccggaaggccgccagcgtaccggccagatcagcgcattgctgccgttgctgatctcgtccatcagcgactgacgtaccgacgacagcgtcgtgacgaacggccatggatcgtcgttgcccggcggcggtgacgccgggcgctgcacggtcaggaacgcggagccgaccggattcgcgtccttctcgccatgccgaaggtcatgccagaaattggccggcagatcgtcatcgagaatccaggacatatcgctcatctgatggtctcgccaatcggtctcgctcggccagacgacttcatgacgatcgaccttgctgctcgcgatgtcgtatcggtacaggcttggcttgctcttggcgtcgggctggccgtcgaaccagacggcgctgccgtcgccgttgatcatcatctgtcgcggcccctccttgccgtgccagatttcgtccgcctgcaacgcgccgttggccgcgcgcagccgccacacgtactcgttccagccgcggttgtcggccacctgggcgctgaacagcaggctgccatccggcaggccgaggatgtcgtgcgggtacagcaacgtgcgttgcgacgggtcggtcacgaacttgtcccagcggatgatcgacggcttgattaccggggcgctcgggtccggcgcctccggcttgatgtcgggggcggcatcgacggtgccgagggcaactgccatgcagcgggcgacgtggcgatttccagcctgactggcagtgcggacaacgcgtcggtcaatgccgtgaacacgtcggccgggacgacggagatgccggtcctgctggattgcgtccggttgccgctgaacatgtccaggtcctggagtgtcaatgctttccacaggctgtagtcggggttgggccgggagtcgatgcgaccgaactgaacgaccgtcgccggatgcccgaatatggcgcttgtgtcctgcaccctgacgaacagcgcgctccggtactggccggtgatgccgtcgctatgatcctggcgggcttcccagaacgcgtaggtgggttgcagcgcgggcaggccggagccgcgggacagccggtcgacgcgggcccgagcctgatccatgcgccagtccagttcctgccgggtgattgcgccttgttgcagcgcctgctgcagtttcggcagggtcgcatggtcggcgatggctgcgcgcaggtctggccggcgcgacaacaggacatggctccaggggtccggcaaattctgcaactgccagctatcggcactggccttgaccgggctcgtccgttgcagcacgcgctccacgagcggctgcacctggtcatagggagcggagaccagcaggaacacggcttccgcataagcttgccggttcttgccgttgtcccagatgaggacctgttcgcctcgacgggcggctacttcgtaatcgtcgtcgtgcccggtgtcgtgcagttgctcgaatctccaatgcaggccgtcgacggtggtgtctggcagcgggtcggcctggcaggcgagcggggttgcgatgccgatcagaatcgacaggaagcatgcgaggcgttttctcattgacgttatgcctggatgcagcgggaatttggacgtaccgattctaagtgcggcatcgtgtgcgtactgcggtgtgccgggtggcattgcgcggggtatcgatttttgcgccgttcggtatcaccgcgtacaggcgttgatgatgccttgcttgagattgatgcgaaatttgttcaggtcgccgggtgctgagcgcagcttgaagagattgagggcgacccggagatatcaggtgtcgtggcgatcgcgtcgcgggcggggaatttcgatcatccgtgccacttgccgtgacatcggaaaaatgaaaaagccgctgtttctttcgaaacagcggctttcgcatttggtggcgaatcagggactcgaaccccggacctgcggattatgattccgtcgctctaaccgactgagctaattcgccgaagagttgaattatgtagatcgacgcccgggctgtcaacacctttttcatcttccgcgaaaaagttgccggcggcccgtgccggcctcgctgtggggcgggttgtcgttcgccggaacccgcgtccggcaaacgacaacccgcccttcatcctcaatcctgcgcgtagatgttcgagtccttcgtctccttgacgaacagcaggccgatcacgaacgtggccagcgcgatcacgatcggataccagaggcccgagtagatgtcgcccttcgccgcgacgatcgcgaacgcggtggccggcaggaagccgccgaaccagccgttgccgatgtgatagggcagcgacatcgacgtgtagcggatccgcgtcgggaacatctcgaccagcatcgcggcgatcgggccgtagaccatcgtcacgtagatcacgagaatcgtcaggatcacgatcgtcatcggccagttgagctgcgccgggtccgccttggccgggtagccggccgccttcagcgtcgacccgagcgtcttgtcgaacgccgcgccctgcgccttcgcgtcggccgccttgccttcgtaggccgggatcaccgtgtcgcccaccttgatctgcgccgtcgcgccggccggtgccgcgacgttctcgtagttcaggccggctttcgcgagcgcgctcttcgcgatgtcgcacgagttcgtgaacttcgacgtacccaccgggttgaactggaacgaacaggcggccggatcggcgatgacggtgatcggtgacttctgcgtggcgatctcgagctgcgggttcgcgtagtgcgtgagcgccttgaacagcgggaagtaggtcagtgccgcgatcaggcagcccgcgaggatgatcggcttgcggccgatcttgtccgacagcgaaccgaagaacaggaagaacggcgtgccgatcagcagcgcgatcgcgatcaggatgttcgcgctcgctccgtccaccttcagcgtctgcgtgaggaagaacagcgcgtagaactggcccgtgtaccacacgacggcctggccggcggtcaggccgacgagcgcgaggatcacgatcttcaggttcttccactggccgaacgcttcggtcagcggcgccttcgacgtcttgccttccgccttgatgcgcaggaacaccggcgattcgttcaactgcatccggatccacaccgacaccgcgagcagcaggatcgacgcgacgaacggcacgcgccagccccagctgccgaacgcttcctcgccgatgaaggtgcgcacgccgaggatcacgagcagcgacaggaacaggccgagcgtggcggtcgtctggatccacgcggtgtagaagcctcgacggttggccggcgcgtgctcggcgacgtaggtcgccgcgccgccgtactcgccgccgagcgcgagaccctgcaacagccgcatcgcgatgaagatcacgggcgcggcgatgccgatcgacgcgtagccgggcaggaagccgaccacgaaggtcgagatgcccatgatcacgatcgtcacgaggaacgtgtgcttgcggccgacgaggtcgccgaggcggccgaacacgatcgcgccgaacggccgcaccgcgaagccggccgcgaagccgagcagcgtgaagatgaaggcggcggtcgggttgacgccggagaagaagctcttgctgatgtaggccgcgagcgagccggccaggtaaaagtcgtaccactcgaacacggtgccgagcgacgacgcgaagatcaccttcttctcttcactcgtcatcggcgagtgcgaaatttgcccgcctaacgttgccatgagtcgtctccaagtccctttgtaggtgtgcggccgccttgggtgaggcgggcctgttgacgattattggtagggaaacttacggcggactgactcgcgtctgcaaagcaggtgtgcgtcaaatttcgtctaagtttctgctttgggtgtctatcacgcttgcaacgtcgccaaaatcgtcgatttcggcgtaatccgggcagcctgcggcggcgcgcgtcagggttaatccggggcggcttcggtcagcggcaggctgacgcgcacgagcgtgccggcgaggcgcggggcgtgctggtagacgtgatcgtcgagcgtcagcgtgccgccgtgctgcgtggcgatctcgcgcacgatcgcgagcccgaggccgctgccgtcgccttcgcggccgaggatccggtagaagcgctcgacgacgcgctcgcgttcggcggccgggatgcccggcccggtgtcctcgacttcgagatgcacgaaccgcgcggcgggctcggcgcgcacgcgcaccgtgatgcggccgccttccggcgtgtagcggatcgcgttgtcgatcaggttgccgagcatctcgcgcagcatcaccgggttgccgtcgacgtcgagcggcgtgtcgtccggcgggccttcgtagccgagatccatgcgtttcgcgagcgcggcctgcacccagtcgcgcaccgcgcgccgcgcgagcgaggcgatctcgaccggctcgaacgtcagcccgctcgcacggttctcggcgcgcgcgagcgcgagcaactgcgtgacgagccgcgcggcctgctcggagctcgtcgcgatctgctcgagcgagcgctgcacgtcgggcggcacggggtggcgcagcgcgaactcggcctgcgtgcgcaggcccgcgagcggcgtcttcatctggtgggcggcgtcggcgatgaagcgcttttgcagtgccatgttctgttcgagacgggcgagcaggtcgttgaacgacgtgacgagcggctcgatctcgggcggcgcgcgctgcgcctcgaccggcgacaggtcgtcgggccgccgcgcgcggatgtgcgcctgcagcgcgttgagcggcgcgagcccgcgcgacagcccgaaccagaccagcaggatcgcgagcggcaggatcacgaactgcggcaggatcacgcccttgatgatgtcgttcgcgagcgcgttgcgcttgtccagcgtttcgccgacctgcacgagcacgggctgtgcgctgtccgattgcggcagcgcgaccgtcgtacgcgacgcgcacgtcgttgccgcgcagcaggtcgtcgcggaacatgacgacgccaggcggcgggcggtcctcgtcgcgcggcagcggcatgtcggcttcgcccgcgaccagttcgccacgggtgccgagcacctggaaatagacgctgtcgacgttgtccgcgcgcaggaagtcgcgcgtctgctgcggcagcgtcagctcggcgacgccgtttaccggatggatctgccgcgcgagcacgtacgcgttggtctcgagcgcgcgatcgaacggaccgttcgcgatcgtcttcgcgacgaggtaggtgacggcgatgctcatcggccacagcagcagcagcggcgcgagcatccagtcgaggatctcgccgaacagggagcgcgggcgcggcgcctcgggcgcatcggtttcgtcgggcggcgcgaacgggttctcgtagcgcgcgtcgcgcgcctcgtcggcggccgacgacggcgcgccggtcgggtggcgggtaggggccggcgtggccatcgcggcgacgcccggggtcagcgcagcggcgtgccggccaccgcgggctggggcgcggccgagtcggcgggcgtggccggcgccgccttctcgaggcagtagccgaggccgcgcacggtcgagattcgtacgccgctgggttcgatcttcttgcgcagccggtgcacgtagacttcgatcgcgttgttgctgacttcctcgccccattcgcacagatggtcgacgagctgctccttcgacacgagccggccgatccgctgcagcagcacctcgagcaggccgagctcgcgcgcggagagatcgagcacgcgatcgttcgcatacgcgatgcggccgacctggtcgaacgcgagcgagccgtggcgcacgacggtcgggccgccgcccgcaccgcgccgggtcagcgcgcgcacgcgcgcctcgagctcgttgagcgcgaacggcttggccatgtagtcgtcggcgccgaggtcgagccccttcacgcgctcgtcgacgctgtcggcggccgtcaggatcagcacgggaggttggaattgcgggcgcgcaggcgcttgagcacgtcgagcccggacattttcgggagcccgaggtcgaggatcagcaggtcgaacgtctgcatcgacagtgccgtatcggcatcgacgccactcttcacgtggtcgaccgcatagcccgattggcggagtgaccgggtgaggccgtccgcgagtatgctgtcgtcttccgcgatgagaattcgcatggtgctgaccgatggccggcagggcgttcgcgccggccggctgtctccgaagttattcgtgtacaacgcagcctgcattgcgggcttgcacaaaacactgtttttatacagtgtctgcattcgtgggcggcgcttgaaagcgggcgcgcctctgacagacgctgctcatcatagcaaaggacgattcatggaagatagcaagaagggctccgggatgaccgccgagaagagcaaggcgctggccgccgcgcttgcccagatcgagaagcagttcggtaagggctcgatcatgcgcatgggcgacggcgaggcggcggaagatatccaggtcgtctccacgggttcgctgggtctcgacatcgcgcttggcgtcggcggcctgccgcgcggccgggtggtcgagatctacggcccggaatcgtccggtaaaaccacgctcacgctgcaggtcatcgccgaactgcagaagctgggcggtaccgcagcgttcatcgacgccgagcacgcgctcgacgtccagtacgcgtcgaagctcggcgtgaatgtgccggagctgctgatctcgcagccggacaccggcgagcaggcgctggaaatcaccgacgcgctggtgcgctcgggctcgatcgacatgatcgtcatcgactcggtcgcggcgctcgtgccgaaggccgaaatcgaaggcgagatgggcgattcgctgccgggcctgcaggcccgcctgatgtcgcaggcgctgcgcaagctgaccggcacgatcaagcgcacgaactgcctggtgatcttcatcaaccagattcgtatgaagatcggcgtgatgttcggcaacccggaaaccacgacgggcggtaacgcgctgaagttctatgcgtcggtgcgtctcgacatccgccggatcggctcgatcaagaagaacgacgaggtgatcggcaacgaaacccgcgtgaaggtcgtcaagaacaaggtgtcgccgccgttccgcgaagcgatcttcgacatcctgtacggcgaaggcatttcgcgtcagggcgagatcatcgatctcggcgtgcaggcgaagatcgtcgacaaggccggcgcctggtacagctacaacggcgagaagatcggccagggcaaggacaacgcgcgtgaattcctgcgcgagaatccggaaatcgcgcgcgagatcgagaaccgcatccgcgaatcgctcggcgtcgtcgcaatgcccgatggtgcaggcaacgaagccgaggcggtggacgaagaagagtgatggtcgggcgccgaggtcaggctggcgagccggaggagagcgacgcgcccgaagcggcgggtcgccccggccggcgagccgaatcctcgagcgccgatcggcgggtcgcgggcagccatgccgcgaaccgcaccgcgacgagggcatccgacgatgccctcgtttcgtttgagattgccgcaccggacgatccgttcgacgacgatgaatcgttcgacgcgcacgaccgctctcgtcgtcgcgtgtccggtgtcagtttcctggcgatcgcacagccgatgcgtcggcgccggccaggaagatgtctacacgcgcagcagccagcatccgcgccgcacgcgtcgagcgtcgggcgcttctgccggcacgtctaccaccggcgaacgcaagtcgtcgaagccgccgcggtccttgaaggggcgtgcgctcggctatctgtccaggcgtgaatacagccgcgcggaactcgcgcgcaagctcgcgccctacgtcggcgaagacgaatccgtcgaacccgtgctcgatgcgctggaacaggaaggctggctgtccgatgcgcgttttgccgagagtctcgtgcatcgccgcgcgtcgcgagtcggcgtcgcacgcatcgtcagcgagctgaagcgccatgcggtcggcgacacgctcgtcgaggaggtgaacgcgcagcttcgcgagaccgaatgggcacgtgcgcaggcggtctggcgcaagaaattcggtgcgctgccgcaaacgccggccgagcgggcgaagcaggcgcgctttctcgccgcgcggggcttctcgagcgcgaccatcgtgaagttgctgaaggtcggcgacgatttcccgatcgacgactgaccgtgccgatcgcgcgcgtggcgcgcgattttgctgcaacgcaactgcttccggacaggcgggaatacccgccgtcgcgtcaaagtgtctcaaatacccaatatgctaaaatccgtgggttttcctcttcggcctcaacctccagcatgccgctatccgagcccgtgccccgtcagttgcgacatcgacgcgcaatccgagcggaagcttacgagcgcggcgacggcttgtgggacatcgaagcctgcctgaccgaccacaagccgcgcgatgtcgcgcttgcgtcgggcatccggccccagggcctgccgatccacgaactctggctgcgcgtgactatcgatcgtgacctcaatgtcgtcgacgccgaagcgtcttcggaatgggttccctatcccggtcactgtcaatccgcttccccgcctatcgggccctcatcgggctcaacctcttccgcaatttccgccgcaacgcgaaccggctgctcgccggcgtcgcaggctgttcccatctcaccgaactgtgcgccgtgctgccgacggccgcgatccaggcgttcgccggtgacgtgtggaacgtgcgcgaggagggcggcgaagggccggatcaggacgacgtgcacgccgaaccgcctttccagctcggccgctgccgggcgttgcggttcgacggcgaggtcgtgcggcagtattacccgcggtggtatggcccgcttcggccggatttgcccggtgatggcagcacgaaggaatgaacggaaatcattcgaagaagcgtctaaagcgacttttcatccaactctcagactgaagggaatcacgcatgaagattcacgagtaccagggtaaggaaatcctgcggaaattcggagtcgcggtaccgcgcggcaagccggcgttctcggttgacgaggccgtcaaggtggcagaagagctcggcggcccggtatgggtcgtgaaggctcagattcacgcgggtggccgtggcaagggcggcggcgtgaaggtggcgaagtcgatcgagcaggtccgcgaatacgcgaaccagatcctcggcatgcagctcgtcacgcaccagaccggtccggaaggccagaaggtcaaccgtctgatgatcgaagaaggcgcggacatcaagcaggaactgtatgtcagcctcgtcgtcgaccgcatctcgcaaaagatcgtgctgatgggttcgagcgaaggcggcatggacatcgaagaagttgccgaaaagcacccggaactgatccacaaggtcatcgtcgagccgtcgacgggcctgctcgacgcgcaagccgacgacctcgccgcgaagatcggcgtgccggctgcttcgattccgcaagcgcgcgcgatcctgcaaggcctgtacaaggcattctgggaaaccgacgcatcgctggctgaaatcaacccgctgaacgtctccggcgacggcaaggtcatcgcactcgacgcgaagttcaacttcgactcgaacgcgctgttccgtcacccggaaatcgtcgcgtaccgcgatctggacgaagaagatccggctgaaatcgaagcgtcgaagttcgacctcgcgtacatctcgctcgacggcaacatcggctgcctcgtgaacggcgcaggcctcgcgatggcaacgatggacaccatcaagctgttcggcggcgaaccggcgaacttcctggacgtcggcggtggcgcgacgaccgagaaggtcacggaagcgttcaagctgatgctgaagaacccggacctgaaggcgatcctcgtgaacatcttcggcggcatcatgcgctgcgacgtgatcgcggaaggcgtgatcgccggttcgaaggccgtgaacctgaacgtgccgctcgtcgtgcgcatgaagggcacgaacgaagacctcggcaagaagatgctggccgattcgggcctgccgatcatctcggcggacagcatggaagaggctgcgcagaaggttgtcgcggctgccgcaggcaagtaagcgcgctcaatgaataggtatggcggcgcggcttgcacgcgacgccaatcgaacagaggtcaaaatacatgtcgattctgatcaacaaggacacgaaggtcatcacgcagggcattaccggcaagaccggtcagttccatacgcgggcctgccgtgaatacgcaaacggccgcgaagcattcgtcgcgggcgtgaacccgaagaaggccggcgaagatttcgaaggcattccgatctacgcgagcgtcaaggaagcgaaggcagaaaccggcgcgaccgtgtcggtcatctacgttccgccggcaggcgcagctgctgcgatctgggaagcggtcgaagccgacctcgatctcgcgatctgcatcacggaaggcattcccgtgcgcgacatgatcgaagtgaaggaccgcatgcgtcgcgaaggccgcaagacgctgctgctcgggccgaactgcccgggcacgatcacgccggacgaactgaagatcggcatcatgccgggtcacatccaccgcaagggccgcatcggcgtcgtgtcgcgttcgggcacgctgacgtatgaagccgtcgcgcagctgacggcactgggcctcggccagtcgtcggcagtcggtatcggcggcgacccgatcaacggtctgaagcacatcgacgtgatgaagatgttcaacgacgatccggatacggacgcagtcgtgatgatcggcgaaatcggcggtccggacgaagccaatgccgccgagtggatcaaggacaacatgaagaagccggtcgtcggcttcatcgctggcgtcacggcgcctccgggcaagcgcatgggccacgccggcgcgctgatctcgggcggtgcggatacggccgaagcgaagctggaaatcatggaagcgtgcggcatcaccgtcacgcgcaacccgtcggaaatgggccgtctgctgaagaaggcgctgtaatatttcccctgggttcgtcctgcaaaaacgccggcctagccggcgtttttgttatgctcgcgcaatgaattcgtaagcacccaccgggcatgcgtcatgcatgtgccggcgatgaacccggccgcctgccaggccgccactgtcctgcacatcaccccatgctcgaattcctgacgtcgctgcactggggcgccgtgctccagatcgtcatcatcgatatcctgctcggcggcgacaacgccgtcgtcatcgcgctcgcatgtcgcaacctgcccgcaaaccagcggctgcgcggtgttgtctggggcaccgcgggtgcgatcctgctgcgcgtcgcgctgatcacgttcgcggttgcgctgctcgacgtgccgttcctgaagttcggcggcgggttgctgctgctgtggatcggcatcaagctgatggcgccggccgccgacgcgcacgacgacatcaagccggccagccggctgtgggacgccgtgaagacgatcgtgatcgccgacgccgtgatgagcctcgacaacgtgatcgcgatcgccggcgcggccgagcaggccgacccgtcgcaccggatcccgctcgtgatcttcgggctcgtcgtcagcgtgccgatcatcgtgtggggcagcacgctggtgctgaagctgctcgaccgtttcccgatcgttgtggcgctcggcgccgggctgctcggctggatcgcgggcggcttgatcgtgaacgacccggtcggcgaccgctggccggtgctcgatacgcagccggtgctctacggggcgagcatcgcgggcgcgctgttcgtggtggcgatcggttacgcgctcaggcggcgcagcggcgcaccgcgcgcacactgacactggccatccggccgactgccggattcgcggcctgctggctacgatcgagacgcctgcctttaacggcaggcgtttttcgttccggagcctgccatgttcgaagccttttccgtttccctgttccgtcgtgttgccgccgacctgcggcgcgcaaaccggtcgtcgccgcgctggcggccggccggcttcacgctgatcgaactgatgatcgtgctcgcgatcgtcggcgtgatcgccgcctatgcgattcccgcgtaccaggattaccttgcgcgctcgcgtgtcggcgaggggctcgcgcttgcgtcgtccgcgcggctggccgtcgccgacaacgccgcgagcggcgcgggcctcgacggcggctacagcccgccggccgcgacccgtaacgtcgaatccgtcgcgatcgacggcgagaccggccagatcacggtcgccttcaccacgcgcgtcgcggcggcgggcgccaatacgctggtgctcgtgccgtccgcgcccgacaaggccgacgcgcccaccgcacgcgtgccgctcaaaagggcgcgatgcaggccggcgcgatcgcgtgggagtgcttcgccgccggcaaggacgcgtcgtcgctgccggcgccgggagccgggccgttgccgggcgatgccgcgacgctgcctgcgaaatatgcgccggcggagtgccgcgcgtagtgccggcagcggagcagggcggcacggcagcatgccggccgccgcttcggtcggccggggcggccgccctgcgccggggcgcggcgcgaaggccccgcacagagggggaaagttttgtatagtgcgccggttgctgacatccggttcgctcatgccttctactttttcccgttcgttgccgctcgttgcgctggctgtcgccctgatcgtgccgtacgcgatcacgaatcacacgtatccgatcccgaccttctattccgagttttccgcgctggtgctgtatctgctggtgggagtgtccgtcgtgctgctcgcgcgcaccggtcgcccggccgaaccgttcgccgcgccggccgcattcgttgcgccgctcgggttcgcggtggtgctcatcgcgcaggtcgcgctgattccgctcaaggtgccgtcgatgaactggctcgcggtcggctatctcgccgccgcgctggtcgcgatgcaggcaggttttacgctcgcgcgcgacgggctggccgaggccgtgtcgcggatgatggccggcgcgctgctcgtcggcggcgtgttcgcggtcggcacccagatcgtgcagttgttccacctcgagtcggcgctgtcgccgttcgtcgtgatgtacaacgtcgcggtcgaccgccgcccgtacggcaacatggcgcaggctaaccatctggccagctacatcgcgttcgcgcttgcgggcgcgctgtatctcgtgcagacgcgccggctcgcggtatgggcgtggctcgcgctgtcgctcgtgctgtcggtcggccttgcgctgacggtgtcgcgcgggccgtggttgcaggtcgcggtgatggtcgtcgcgggcttctggatggcgtggctcgaaacgcgccgagcaccgggcaatgcgcgcgcgtggctgatcccggtcgtgctcgcggtggcgttcatcgcggtgaacgtcgcggtgcgctgggccaacgtgcactttcacctgaacctcgcggaatccgcggccgaccggatgcgtgacgcggggcagatcgcgccgcgcctcgcactgtggaagtacgggctcgcgatgttccgcgagcacccgctgctcggtgtcggctggggcgagttcccgtcacaccagttcgcgctcgtgcgctcgctgggcggcgtcgagatcgcgaacaactcgcacgacatcttcatcgacctgctcgcgaagtccggtctcgtcggcctgggcgtgctcgtcgttgcgctcgtgacgtggtttgtgcgtgcggtgcgcgcaccgcagtcgagcatgcgcgtgttcggcttcgcgctgatcggcatcctgctgatgcatgcgctggtcgagtatccgcagcagtacatgttcttcctgttgccggcgatgttcgtgatcgggctgctcgacgtgaagccgctgcgtttcttgccggggcgcgcagccttcgggctgttcgcggtgctgtcggtcggcggcgtgctggcggcggtgcctgtgctgcgcgattaccagcgcgcggaggtactgtattacggcagcgatccggccgcgcaataccgtgacgcgccgtcgtttctgttcggcgcctggggcgaatacggcgcggccacgctgctcccgatttcggcggacgacctgccggccaagctcgccgcgcacgagcgcgcaatcgcgctactgcccggcgagacggtgctgcgccgctatgcggtgctgcaggcgctggccggccgcgaagccgacgcgctcgacaccgtcgcgcgcctgcacgtgttcgcgaaggagctgaaggactggccgcaacagctggcggcgctgtacaagctgtgcgaccagcagccggcgctgaagacgttcaaggcggcggtcgtcgcgaaatacggcgaagttccggccgacgcggccgacgacgaggacgacgacgattcggattgatacgcacggcccctgccggcattccccgttccggcaggggccgcgccgtgcgagagcagcggcgcgtgccgaacgcaaccgcttggcgtgaacccggcgaatccggccgcgtatcgattacctcgtggattgcgcggattccggctgaagtcgcggcgattcgcgtcaaccattgtcaaatcgccgccgctcgccgggcggcgcgtgcacaatgcgcgaaagcgctcgcgtgccggcccgtgtggggcaggggcgacgcgaacaccggcaacaccgggccaccgggaagtccgccacgcaggatcgcggccgagcatcgatcggccgtgcggccgtaacggggcgccggtccgatggccgcggcgcggtgtgacgcatgcgatgcgaccgggcgatgttcccggcgcgcggcgcgttcgtccgcaacagtgctgaagaacgatattcgaccatggctattcgctcgacctacctgatcctgcccgccgtcgcgatgctgttttccggctgcgcgatgctgtcgtcttcgcaggaaagcaagctgacctgccacattccgcgcgccgtctatccggataccgcgaagccgctcacgcgtccggcgaccgtgctcgtgcgcgcgctgatgacgacgtccggcgaagcgcagaacgtcaccgtgacgacgagcagccgtaatgcggcggccgatcgcgcggccgtcgacgcgatgacgcacgcaacctgcgtgcagacgggcgcgaccgcgaatccgttcctgctgacccaaccgttcgtgttcgagccgcagcgcggcaagtgatgcgcgggcggcgcggcgtgcgtgccggtcgccgcccggtattgtttcctgtcagccccttcgctgcgcgcggccttgggccgcgcgtgcccgacattcagtgccgcggcatcaggttcgcgccgcggcaagccggctcggccgccgtgctcagcccgagcagcgtgaacccgttgcgttcctgacgaatctgcgcgtagtgccgcgcaaccgtctcccggtgttgcccgtcagatcgagttcgacctgaaagcggtccttgctgtccgagcagccacgcaccgggccgtactcgaacccggtaccgggcgccttgcgggccttgtcgaacgcctgccggcccttcagcgcggcagccgcggcggcgggttcgctccattcgcgcgcctgcgcatcgttcacattcagccattcgtcgacgaaatcgcggccgttgagcgcgacgggttgtacgcgctgcacggtgccgccgtagacgcgatagcggaagacgcctggccgcgtcaacacttcgctgtccatcgagccgaccgtcgcgcgcacctcgaagccgtcggggcgcaccttgaaccggatcgggttttcgtcgagcacgtagctgttctcggcatggaacagcacgcgttgcgcggtcgggccgttggccggtgcgaccacgtccgtggcgaaccggctccagcgcgacgcgcaccacggcgtgccgtggacgaccgcgacctgcccgccgggcagcgccgagaaccagaagccgccgccgtacgcgccgccgatgtccttgtagtcgtcggcctgccagcgcagcacgcggcgccagccgccgttttcccatgcgtaggcggtcagcaggttgtcgtcgccgcatgcgatgtcgaagccggcgcgcacgaagagcaacgggcgggacgtgccgccgcgttcgacgtcgacgtccggattgcggccgaacgccgattcgccgtctttcggctggacgggccgggccggcacaccgagcgcggctgcgagcgtgcgtttcagcgcggccgggtcgacctgttcgtcactgcaggcgagctgcgcatcgatcgcgccggcgagcgcctgcttgtacgcacgcagcgcgtcgcgcagcggcggcgaaatctcgacgccgggcccgtcgctcggcggattgcggatctgctgtacgcggtgctgcgcgtcgatggccgcgcgcgcggcggtgtcggcggcagggcaggcgccggcggccgatgcgacggccggcagcaggaagagcgcgcacagcagcggcgcggcgcatttcagcgtgggattcttcatgagtgaagtgtttttctggtttttatcgttcgaacggagcatcgctacggccggcgctgtcccgtgaatggcggctgttaccgctggcggtcaacccgcgacgtcttccgccttccagtctcccgacttcccgccgcgtttctcgcgcacgctcacatcggtgatcaccatcccgcgatcgacggccttgcacatgtcgtagacggtcagcagcccgacctgcacggcggtcagcgcttccatctcgacgccggtccggccgaacgtctcgacctgcgcgacgcagtggacgcccggcagtgcgtcgtcgagctcgaaatcgacggccacgcgcgtcagcgcgagcgggtggcacagcgggatgaggtcggccgtgcgcttggcgccctggatggccgcgatgcgcgcgacaccgagcacgtcgcccttcttggccttgccgtcgcggatcagtgcgaacgtggccggcagcatccggatcgtgccgcgcgcgatcgcgatgcgttgggtttcctgcttgccgccgacgtcgaccatgtgcgcatggccggcggcgtcgaaatgggtgagtcctgacatgtcgtgctccagtggaacggcgtgctcgcacgagcacgtccgtcgatcctgcttcgcgatcgggcagcgcgcggcatccgaaaccggctccgcgacccgatgcaacgcttcaacgggcgcttatcatagcagcggcgttcgcgtcgccggagcgcagatggcaccgccgcggcacgggacagtcatcgcggcgccggtacaatgacccgaatattcagaccaaacgccgcgatgcgcgcccggcgcgcgggacggcgtcgttttcatcctgccatgcgtgtcaaacagttgcttgccgtgtcgctgtcggtggcgctcgcgttgccgccgagcggccatgcgcagcgtgcgtccgcaccgccgctcgaagcggcggccgacggcgcccggtcgatttccaccgtgccgtccggcatcgcggccggcgtattcggtacgtacggcggcgcggagagccggttctccgacgcgggcggcgcatcggcaccggccgcgagcctgcgcgccccgcttcgcgcgctcgagctgcccgacctgggcgacggctccggcggttcgctgacgccgcaggccgagcgccggctcggcgagcgggtgatgcgcgaagtgcggcgcgatcccgactatctcgacgactggctcgtgcgcgactacctgaatgcgatggcggcgcggctcgcggccgcggcggccgcgcgcttcatcggcggctacacgccggacttcgacctgttcccggtgcgcgatccgcagatcaacgcgttctcgatgccgggcggcttcatcgggatcaacagcgggctcgtcgtcacgacgcagacggagtcggaactcgcgtcggtggtcggccacgagatggggcacgtgctgcagcggcacatcgcgcggatgatcggcgcgaacgagaagaccggctacacggcgctcgcgacgatgctgctcggcgtgctggcgggcgtgctcgcgagaagcggcgacctcggcagcgcgatcgcgatgggcgggcaggcatacgcggtggacaaccagctgcgcttctcgcgttcggccgagcgggaggccgatcgcgtcggcttccagttgctcgcgggcgcgggctacgacccgtacgggatgccgggcttcttcgagcggctcgatcgcgcgtcgatgggcgatgcgggcgtgcccgcgtatgcgcgcacgcacccgctgaccggcgagcggatcgccgacatggaggatcgcgcgcgccgcgcgccgtaccggcagccgcgccagtcgcccgaatacgggttcgtgcgcgcgcggctgcggatcctgcagaaccgcgcgccgaccgacatcgcggccgaagcgcgccggatgcagtccgagatcgacgatcgcacggcgccgaacgtcgcggcgaactggtacggcatcgcgctcgcgaacgcgcagctcggcgagtacgacgcggccggcaaggcgctcgcgtcggcacgcacggcgttcgacgcgcgcgagcggcgcgaggacgatccggcgacgagttcgccgagcctcgacgtgctggccgccgccatcgcgcgccgtgcggggcgcgccgacgaagcggtgcggctcgcggcgctcgcgcagcggcgctggccggcgtcgcacgcggcgatcgtcgagcatcttcaggcactgatcgcggcgcgccgtttcgccgacgcgcaggcgcaggcgcgcgcgcaggcgaaggccgaccccgagcagccggactggtgggactatctcgcgaaggcgagcgacggcaagggcgacgtgctggcgcggcgccgcgcgctcgcggagaagcttgcgctcgacggcgcgtggccgtcggcgattcgtcagttgaaggaagcgcgcgacgcgaaggacgtctcgttctacgagcagtcgatgatcggtgcacggctgctggaattcgaggcgcgctacaaggaggagcgcgacgacgagaagaacggccgcgggtagcgtccggcgtgcgccgggcgcgcgcgaagccgctgcgggtcaggcgtcgccgccggccgcgtcgcgggcctgtcgtgccgggctggcgacgtagccgaaccgtgcaggcacgtccgcgcagacgatgctgccgagcggcagcgtgcggccgtcgcgccagcgcagtaccggcggtgcggcatcgaaatccgcgtgatcggcgaacagcccgagatcgtgatcgtgcagcgccgcgatgcgcggcgccgtgccggccgagcgaaacagcacgccgcccgcgtcgtcgagccatgcttcgtccggttcgaacggcgtaccggtctggtcggtgagcgcgagttgcccgtcgcgctcggccaggcggacgacccacggcgtataggcaagctcgacgtacacgcgctgcggtccgttctggaagaaccactggccctgcgcgtcgcattcgtagttgcggccgatgaacgcgttcagcgccgcatgccggatcggcgagccgagctcgccggccgcctgggccgcgtcgtcgcgcagccgccattcgccgcgccggtcgagcagcagccagccggtgcagtgcggcacgttcggccatttggcgagggcctgcctgacgatgtcatccatggtcgacgaatttggagcaatagccgaacacccgcgccgacagccagtcgagacggccggggaacggcccggtcatgaaccccgcgtgtccgccgtccgcgggctggtcgagctcgacggccggcgatacgtcggccgggcccggcagcgcggactcgggcaggaacgggtcgttgcgggcgttgaggatcagcgtcggcacgtcgatcgccggcagcagcggccgggtcgtcgccttcgtccagtagtcgtccgcgtccgcgaaaccgtgcagcggggcggtcacgacctcgtcgaagtcgcgcatcgtcacggcctgcagcatcgcttcacggtcgaacaaccccggatactggtcgagcttcgcgagcgccttgcgcttgagcgtcttcaggaagctgcgcgtgtagaccatcgcgaagccttgcgacagcgcgcgcccgcccgcgtgcacgtcgatcggcgtcgagatcgcggcggccgcccgcaggatcgacgtgtcgctgcgatgctcgccgagccagcgcagcagcacgttgccgccgagcgacacgccggccgcaaccagcggcccgcgatgctgcgtggcgagccggcgcaggatccagtcgacttcggcgctgtcggcgagatggtagaagcgcggctggcggttgatctcgccgctgcaactgcgaaagtgcgggacgaccgcgtgccagccctttgcgcgcgcggcggccatcatcgcgagcgcgtagtgcgagcccgagctgccttcgaggccgtggaacagcacgaacagcggcgcgtcgggcggcggcgccgcgctgtcgagatgcgcgacccagtcgagatcgatgaaatcgtggtcgggggtttcccatcgctctcgtcggtaagcgacggccgggcgtcgtgcgaacagcgcgggcacgatggtctgggcatggctgttcggcagccagcgcggtgcgcgatagcgcaatgaatcgtcgttgggggccggggccccggtcagcggcgaggtgggcggagaagccgtactcatgatcgccccgctaatgcgttgcttcgttcttcgtcagtgcagcggaccctgcccgtgacggatcttcgcggcgaattgtccggccgcctgttcgggaatcgggctcgcgtgaatatgcgcgatgcgccactcgccgcgctcgtgaatcatcacgtacgtggcgaaaaccatgtcgggttcggccgtcaggtcggcctgctgatgcgcttcggcgatcgtatagacgaccgtgccgaggctgtcgtacacacggatgtcgagcggctcgatcgtcacggggcgcgtggcgagccggttggcgagcccgctgcggatctggtcgaggccatgcagatgctcgccgtccgcccatacgcagctggcgaaatcctcgtcgatccacaaacccagcagcgcgtcgagattggcatcggcgacggcctggtagtaagcgttcagcgtatcggcggcggcttcgaagaggcgggcaaaacgtggcatcggggttatctctcgcgcgcgtcgcgcgccgtattcagcacggcggcccggatggagccgccgtacaccggtgaatcggattgcccggcgcgtcgtgcgacgctgccggccagggtcagcgctgcccgacgagcatgccgcgcaaatcgccgaatacctgctcgggaccgagttcgcgcaggcacttcagatggccgagcgggcactcgcgttcgaagcagggactgcattcgagatggagccattgtaccttcgccaggtccgacagcggaggggtgtggcgcggatccgtcgagccgtacagcgcgacgagcggccggcgcagcgcggcggcgacgtgcatcagccccgaatcgttggtgaccaccgcgttcgcgcgcgcgatcagcgcgcatgcctccgacagcgacgtctgcccgcacaggttgcgcacgttcggcgcgtggtcggcgatcgcctgcgcggccgcggcgtccttctgcgagccgagcgcgacgatctgcgtgtacgggaacgactggtggacgatggtggcgagcgacgcgaagtgctcgggcggccagcgcttggccgggccgtattccgcgccggggcagaacacgacgagcggcttgcgggtgtcgaggttgaagcgcgcggacacgcgcgccgtctcgttcaggtccgcgtcgaggcgcggcgcgggcagcgtcttcatcgactcgggcagcttcgcgcccggcgcgtacgcgagcgccgcgtagtgggtcgtcatcggcggccgctcgcccgacttggtcgggttcgcgtgccgcacgttcagcagcccgtagcggtgctcgcccgtgtagccgatccgcagcgggatgttcgcgagccacgggatcaccgcggatttcagcgaattcggcagcacgtacgccgcgtcgtagccgacgtcgcgcaggtcgctcgcgagctgccagcggcgcagcagctgcagcttgccgtgcgcgagatcggtcgcgtagacatcgtggatctcgggcatccgctcgagcacgggcgcgacccacgagggtgcgacggcatcgatcgcgatgcggggatggagctttttcagcagcgcaaaagcggctgcgccatcaatgcgtcaccgatccagttcggtgcgataaccagcgctcgacgcatcaggtcgacttccgatgtcttgatgaagcgcggcgcccaggcgccgcgttcgggttgccagaatggagaacggcggcgcgccggaagcccggctgcgccgcctgggtcggcgggcctgcaagcctgcaggcccggccgccggggctcagtggcccttgacgacctcgccgtcgcgcagcttgtagcgcgtgccgcagtacgggcagcgtgcttcgccgtgcgagacgtcgatgaagacgcgcgggtgcgcgctccagcgcgccatggccgggttcgggcagtacgcggaagatccttggccgtcagctcgaccagcggcatttccttgatttcactcatgagactttctcttatcactcttttgtggggcggtcggtggcgcggcgcgctcagaccttcgtcagccagtgcgcgtacttcgcgttcttgcccgacacgatatcgaaaaacgccgactggagcttttccgtgaccgggccgcgcgcgccgctgccgatcgtgcggttgtcgagctcgcggatcggcgtgacttcagcggccgtgccggtgaagaacgcctcgtcggccgtgtagacctcgtcgcgcgtgatgcgcttctcgatcacctcgatgccggcgtccttcgcgagcgtgatgaccgtgtcgcgcgtgatgccgtcgaggcacgacgacaggtcgggcgtgtacagcttgccgttgttcacgaggaagaagttttcgccggagccttccgacacgtagccgtcgacgtcgagcagcagcgcctcgtcgtagccgtcggccgttgcttcctggttcgccaggatcgagttcacgtaccagcccgaggccttcgcgcggaccatcgacacgttcacgtggtggcgcgtgaacgacgacgtcttcacgcggatgcccttcgcgaggccttcctcgccgaggtacgcgccccacggccatgcggcgatcgcgacgtggatcgtattgcccttcgcggccacgccgagcttttccgagccgacccagatgatcgggcgcaggtagcacgactcgagcttgttctcgcgcacgacttccagctgcgcggcttcgagcgtttcccggtcgaacggcacgtccatctggaagatcttcgccgaattcagcagacgtttcgtgtgctcgtacaggcgaaagatcgcggtgctgccgtcagccgacttgtacgcgcgcacgccctcgaagacacccatgccgtagtgcagcgtatgggtcaggacgtggatcttggcgtcgcgccagtcgatcagcttgccgtccatccagatcttgccgtcgcggtcggccattgacataggattctcctgggaagcagttgtacagcgggttgtatgcagcgttgagccggaaagacgcttattttagcgtcatttgccggcgatccggtcggtcggcacggggccggcgctataatcgcccggtaccgattccaataacgacgggtcgtaccggcaggaggcgccggcggcccgacgaaccgcccgccgcggcccgcttcccatgctcgctcgattgtccgccaccgaccgcttcgcgctgatccagggcgcgcgcgactattccccgacgctgatggcgattctctcgtggggctcgtcaccggcatcgcgatgagcaagtcggtcatgacactcgcgcaggcgagcgcgatgtcgctgctggtctacgcgggctcgtcgcagctcgcggtgctgctcctcgcggcgaagctgccgatctggaccatcctgctcacggccgcgatggtcaacacgcgcttcgtgatcttcagcgccgggcttgcgccccatttctcctacctgccgctgtggcggcgcctggcgatcggctatttcaacggcgacgtgatctacctgctgttccagaaacagggcttcgcctacggtcacgtgcccggcaaggaagcgtatttctggggatggcgctcgcgagctggctgtcgtggcaggtgtcgtcgctcgccggcatcctgctcgcgagcttcttccccgcgagctgggggctggagctggccggcacgctcgcgctgatcccgatcatggtgtcggcggtcgcgaaccggtcgacgctcgcggccgtcgcggtcgcgggcatcgtgtcgctggtcgcgttcgacctgccgtaccggctcgcgctgccgctcgcggtgctcgccgcgctcgcggccggctgcacggccgacttcttcgtcgaacgggccgactggcggcgcatccgcaccgaaaccgtgcacgagaaggagatcgaatgagcgcgacggagatctggatcgtcatcatcgggatgacgatcgtcacggcggtcacgcgtgcgctgttcctgatcggcggcgagcgcaccgtgctgcccgaacgcgcgcagcgggcgctacgctacgcgccggccgccgcgctcgtcgccgtcgtgctgcccgacgtgctcgaaacgccggccgggctgtcgttcgcgctgtccaaccatccgttttacgcgtcgctcgccggcctcggctggtttttgtggcgccgcagcatgctcggcacgatcgtcgtcgggatgctcgtgttcaccgcgctgcgcctgatcttctgatgagccgccgttcaggcccgccgggcaccggccgctcgcgcaggggcattgctgcgttgcggcaatgtgtccgttcccgcgcgcgatcccaaataggcggaattcgccgccgcacgggtcagtctgccaggtggatcggctagaatgcccgttcgagatttttacccgtgcgcgtcatgcgaaccgccagccacggccgcatccggcgccctttcgcggcagcccgcgcacgtccagcgtgaacccctttccccatccactacttcaatctgttcaacatgagccaagtcaagcgtcttaccgacctgatcgccgccggccagctcgccggcaagcgggtattcatccgcgccgacctgaacgtcccgcaggacgaccagggcaacatcaccgaggacacgcgcgtgcgcgcgtccgtgccggccatccaggccgcgctcgacgccggcgcggccgtgatggtcacgtcgcacctgggccgtccgaccgaaggcgaattcaagccggaagattcgctcgcgccggtcgcgaagcgcctcgccgagctgctcggccgtgacgtgccgctcgtcgcgaactgggtcgagaacggcgtgaacgtcgcgccggggcaggtcgtgctgctcgagaactgccgcgtgaacaagggcgagaagaagaattcggacgagctcgcgcagaagatggcgaagctctgcgacgtgtacgtgaacgacgcgttcggcaccgcgcaccgcgcggaagcgaccacccacgggatcgcgaagtacgcgccggtcgcgtgcgcgggcccgctgctggccgccgaactcgacgcgctcggcaaggcgctcggcaacccggcccgtccgctggtggcgatcgtcgccggctcgaaggtgtcgaccaagctcaccatcctgaagtcgctggccggcaaggtcgaccagctgatcgtcggcggcggcatcgcgaacacgttcatgctcgcggccggcctgtcgatcggcaagtcgctcgcggaagccgacctcgtcaacgaggcgaaggcgatcatcgacgaagcgcgcgagcgcggcgcgtcggtgccgatcccgaccgacgtcgtgacggccaaggaattctcgccgacggccgtggccacggtgaagcaggtcgccgacatcgaagcggacgacatgatcctcgacatcggccccgatacggcgaaggcgctcgcgagccagctcgagaaggccggcacgatcgtgtggaacggcccggtcggcgtgttcgagttcgaccagttcggcaacggcaccaggacgctcgcggaagcgatcgccaaatcgtccgcgttctcgatcgcgggcggcggcgacacgctcgcggccatcgcgaagtacggcatccacgaccaggtcagctacatctcgacgggcggcggcgccttcctcgagttcctcgaggggaagaagctgccggcggtggaagtgctcgaaacgcgggcggcctgagcgcggcggcgcgcgcaggggtgatgaaggccgcgcgctccgcgaaagcggagcagccggccggcgcgggcaagcgcaaacgcgccccgcgcgggcgaacaccgccccgcgcgcaccggcggccgctggcgacgcggccgagcagcaccacgagattcagaacaaagcgatgccgggcgcaagcaccggcacgcccccgagcggccgccgctgggcccgccgcttccggctctcgcagcgtttcacccagcgcatccaccttgatccagatgaggagtttcatgcagcgcgccaccaagatagtcgccacgatcggcccggcttccagttcgccggagattctgttgcagatgatgcaggcgggcctcgacgtcgtgcggctcaatttttcgcacggcacggccgacgatcaccgccagcgcgccgagatggtgcgcgaggccgcccgcaaggtcggccgcgagatcgcgatcatggccgacctccagggcccgaagatccgcgtcggcaagttcgagaacggcaagacgacgctgacgccggggcagcccttcatcctcgatgccggttgcgagctcggcaacgacgagcgcgtcgggctcgactacaaggaactgccgcgcgacctgaagccgggcgacctgctgctgctgaacgacggcctgatcgtgctgatcgtcgagcgtgtgctcggcgacgagatccacacgatcgtcaaggtgggcggcgagctgtcgaacaacaagggcatcaaccgccagggcggcggcctgtcggccccggcgctgaccgcgaaggacatggaagacatccgcaccgcgatgtcgcttggcgcggacctggtggcggtgtcgttcccgaagaacgcgaccgacatggaaatggcgcgccagctcgcgaacatcgcgggcgcgccgtacggcatcaagccgaagatgatcgcgaagatcgagcgcgcggaagcgattccggcgctgcagagcattctcgacgcgtccgacggcatcatggtcgcgcgcggcgacctcgcggtggaagtgggcaacgcggccgtgccggcgctgcagaagcgcatgatccggatggcgcgcgagtcgaacaagctcgtgatcaccgcgacgcagatgatggagtcgatgatccacgcgcccgtgccgacccgcgcggaagtgtcggacgtcgcgaacgcggtgctcgacggcaccgacgcggtgatgctgtcggccgagacggctgccggcaagtacccggtcgtcacgatcgagacgatggcggccgtgtgcgtcgaggcggagaagtccgaagaggtcgagctcgacaaggatttcctcgaccgcacgttcacgcggatcgaccagtcgatcgcgatgggcgcgctgttcaccgcgtaccacctcggcgcgaaggcgatcatcgcgctgaccgaatcgggcgcgaccgcgctgtggatgtcgcgtcactacacgcacgtgccgatcttcgcgctgacgccgcgcgtcggcagcgagcgcacgatggcgctgtaccgcaacgtgacgccgctgcacgtcgacttcaacagcgaccgcgactcggcgctgcaggcggcgctcgagatcgtcgtcaagcaaggctacgtgcagcacggcgacatggtcgtgctgaccgtcggcgagccgatggggcaggcgggcggcaccaacacgctgaagatcgtgcgggtcggcgagcactattgagcgccgattgagcaccgcgccggccagcgtgccggccgcccggatcggctgaaaaatcgatccggcaccgtttaatacgcgaaagccgcgtggggtccgaagccccacgcggctttttttctttttgcccgcattgtgccgtgcgaacgtaacaaattgcgagtcggcgccaccgggcggtcggaatcggaggcgcttcgcgataaaatgcggctattcgacgctcagccgcgccgtgccaccccggttcgaacgggagagcgccgcgccggcgtcagggcgcaccggttttcattccaaggagttccacaatgcctctcgtatcaatgcgtcaattgctggaccacgcggcagagcacggttacggcctgccggccttcaacgtgaacaacctggagcaggtccaggcgatcatggcggcggcggaccaggtcggcgcgcccgtgatcatgcaggcatcggccggcgcgcgtaagtatgcgggcgagccgttcctgcgccacctgatcgaagcggcggtcgaatcgtacccgcacatcccggtcgtgatgcaccaggatcacggccagtcgccggcagtctgcacggccgcgatccgcagcggcttcaccagcgtgatgatggacggttcgctggaagccgacggcaagacggtcgcgtcgtacgagtacaacgtcgacgtgtcgcgcaaggtcgtcgagatggcgcactcgatcggcgtgacggtcgaagccgaactcggtgtgctcggctcgctcgagacgatgaagggcgacaaggaagacggccacggcgcggaaggcacgatgacccgcgagcagctgctgaccgatccggagcaggcggccgatttcgtgaagctcacgcagtgcgatgcgctcgcgatcgcgatcggcacgtcgcacggcgcgtacaagttctcgaagaagccgacgggcgacatcctgtcgatccagcgcatcaaggaaatccacgcgcgcattccgaacacccacctcgtgatgcacggttcgtcgtcggtgccgcaggaactgctggccgagatccgcgaattcggcggcgacatgaaggaaacctacggcgtgccggtcgaggaaatccaggaaggcatcaagcacggcgtgcgcaagatcaacatcgacaccgacctgcgtctcgcgatcaccggcgcgatccgccgctacctgttcgagaacccgggcaagttcgatccgcgcgactacctgaagcccgcgcgcgaagcggcgaagcaggtctgcgtcgaccgctacctcgcgttcggctgcgaaggccaggccggcaagatcaagccgctgtcgctcgacaagatcgccgagcagtacaagtccggcgcgctcgcgcaggtcgtgcgctgagactgtagtacgattgcccccgcccggtactgccgccgggcaagggctggccgcccggttgccggatccgatccggccccggtagccgctccgtccggccgaacaagggccggccggcaaccgccgggcgccgtcgcccgccggttcgccgacgtattgcaagaccgccgttcccgcctgccgcggggaacggcgtttcctttgtttggctccttatctgcgaaaagacgatgtctaccctttacgaatccacgctccgctcgctgccgctcctcggtcgcggcaaggtccgcgataactacgcggtcggcaacgacaagctcctgatcgtcacgaccgaccgcctgtcggcattcgacgtggtgatgggcgagccgattccgaacaagggccgcgtgctgaaccagatggcgaacttctggttcgacaagctcgcgcacatcgtgccgaaccacttgacgggcgacgcgccggaagcggtcgtcgcggccgacgaggtcgagcaggtgaagggccgcggcgtggtcgtcaagcgcctcgagccgatcatgatcgaagcggtcgtgcgcggctacctggccggcagcggctggaaggaataccaggcgtcgggcgccgtgtgcggcgtgcagctgccggaaggcctgcagaacgcgcagaagctgcccgagccgatcttcacgccggccgcgaaggccgagatgggcgaacacgacgagaacatcacgttcgaggaaaccgagcgccgcatcggcaccgagctggccgccaccattcgcgacatctcgatcaagctgtacaaggaagcggccgattacgcggcgacgcgcggcatcatcatcgccgacacgaagttcgaattcggcctcgacaaccacggcaagctgtacctgatggacgaagtgctgaccgccgattcgtcgcgcttctggccggccgaccagtacgaagtcggcaccaacccgccgtcgttcgacaagcagttcgtgcgcgactggctcgaggcgcagccgtggggcaagacggcgccggcgccggcgctgccggccgacgtcgtcgagaagacggccgcgaagtaccaggaagcgctcgagcgcatcaccggccaggcgctcgcctgatcgaggtacatacgacatgagcgaaatccagactgcccacacgcacagcgcgccgctcgtcggcgtgctgatgggttcgagttccgactgggacgtgatgaagcacgcggtcgccatcctgcaggaattcggcgtgccgtacgaagcgaaggtcgtgtccgcgcaccggatgcccgacgagatgttcgactatgcggagaaggcgcgcgagcgcgggctgcgcgcgatcatcgcgggtgccggcggcgcagcgcacctgcccggcatgctggccgcaaagaccacggtgccggtgctcggcgtgccggtcgcgagcaagtacctgaagggtgtcgattcgctgcactcgatcgtgcagatgccgaagggcgtgcccgtcgcgacgttcgcgatcggcgaggccggcgccgcgaatgccgcgctgttcgcggtgtcgatcctgtccggcacgtcgaccgactacgcgaaccggctcgccgcgttccgcgtgcgccagaacgaagccgcgcacgcgatggtgctgccgccgctggaatgacggcatggcgcgcggccgcacgacgcggccggcgccggattttcccactgcggcgggcattttcgcgttccgccgcgaccgaccactgacatgaccgcaactcctgattccgtttcccgatcctgcccggcgcgtggctgggcatggtcggcggtggccagctcggccgcatgttctgctttgccgcccagtcgatgggctatcgcgtcgccgtgctcgatcccgatccgacgagccccgccggcgcggtcgccgaccgccacctgcgcgccgcatatgacgacgaagccgcgctcgcggaactggccgacctgtgcgacgcggtgtcgacggagttcgagaacgtgccggccgcaagcctcgatttcctcgcgcgcacgacgttcgtcgcgccggccggccgctgcgtcgcggtcgcacaggaccggatcgcggagaagcgcttcatcgaggcgtcgggcgtgcccgtcgcgccgcacgtcgtgatcgaatcgtcggcggcactcgccgcgctcgacgatgccgcgctcgacgcggtgctgccgggcatcctgaagacggcgcgcctcggctacgacggcaagggtcaggtgcgcgtgagcaccgcgcaggaagcgcgcgatgcgcatgcggcgctgaacggcgtgccgtgcgtgctcgagaagcgcctgccgctgaaatacgaagtgtcggcgctgatcgcgcgcggcgcggacggccgctcggccgcgttcccgctcgcgcagaacgtgcatcacaacggcatcctcgcgctgacggtcgtgcccgcgccggccgccgatgccgcgcgcgtcgaagaggcgcagcaggccgccgtgcggatcgccgatacgctcggctacgtcggcgtgctgtgcgttgaattcttcgtgctggaagacggttcgttcgtcgcgaacgagatggcgccgcgcccgcacaactccggccactacacggtcgatgcgtgcgcaacgagccagttcgagcagcaggtgcgcgcgatgacgcgcatgccgctcggcaacccgcgccagcattcgccggccgcgatgctgaacatcctcggcgacgtgtggttcccggacggtgcggccggcgtaggcgcgacggctgatgccgtcacgccgccgtgggacacggtcgccgcgatgccggccgcgcacctgcacctgtacggcaaggaggacgcgcgcgtcggccgcaagatgggccacgtgaacttcacggccgaaacgcgcgacgaagccgttgccgcggccaccgcgtgcgcgcagctgctgcgcgtgccgctcgactgaggcgccggccgatgtccatcgatctcccgaacaccgtgacggccgcgcagatcgacgcggccgccgcgttgctcgacgcgggccagctcgtcgcctttccgaccgaaaccgtctacgggctcggcgccgacgcggcgaatcccgaggccgtcgcgcgcatctacgcggcgaaggggcggccggcgaatcatccggtgatcgtgcacctgccgccgggcggtgatcccggttactgggccgacgatctgccggccgatgcgcaggcgttgatcgatgcattctggccgggcccgctgacgctgatcctgaagcgtcatgcgcgcattccggacgccgtgagcggcggccaggattcggtcgggctgcgctgcccgtcgcatccggtcgcacaggcgctgctggccgcgttcagcgcgcggcgcggcgggcatggcggcgtggccgcgccgtccgcgaaccggttcggccatgtgagcccgaccaccgcgcagcacgtacgcgacgaattcggtgacaccgtgcacgtgctcgacggcggcgcgtccgaagtcggcatcgaatcgacgattctcgacctgtcgcgcggtttcccggcgctgctgcgcccgggccacgtgacgccgcagcagatcgccgacgtgctcggccgcgcgccgaagctgccggacggcagcgacgcgaccgcgccgcgcgcgtcgggcacgctgaaggcgcattacgcgccgcgcacgccgctcgcgctgctgccgttcgacgcgctcgagccgctgctcgcggccgcgcaagccgacggcgagcgtgtcgcgctcgtcgcccgtgcgtcgcgcgcgggacgctgggcgcaggccgacggcgtgcatttcgtcgcggcgccggaagatccgcaggcgtatgcacgcgacctgtacgggatgctgcgcgcgctcgaccgcgcgcaggtcgcacgcatcctcgtcgagaagctgcccgagaccgtcgaatggatcgcggtcaacgatcgtctcggccgtgcggcggccgcgttcgaagcgcgcgactgacacgttcgacggttgattcaggaatgaaacgcccgaccggcgaaccggtcgggcgtttttgtttgggcgcgtggccggcggcttacttgccgacgcccgacttcgcgatctgctgttcgacgaactgcgcgaacagcgcgtgcaggtgcgtcgtcgggtggaccgtgtcggcgaacatgtaggtctggtccgcgttcgcgaccgtgtaggtctgcggcgagcagaacagcgacgagccgaatgcggtcgcgttcgcgacgccgtactgcgtggcggcctggaccatcgccttcaggttgcaggcggtgtcggtgttcgacacgctgaagccgttcgccttgtagttcgccgcgatgccgtcctgccacgtgaacgtgtcgagcagcgcgaccttcgtcgtgtcgaccttcagcgcggccagcgtgccggcgagcgtcttgttgaacagccccgacagttgcgtgaacgcggcctgcgtcggcgcgccgccctgcagcgcgagcggcgtgccgccgatgtccggcacgttcgacacgtacacgtgcgtcgcgcctgccgcgacgatctgctggacgatgccgccgagctgctgcgcggccaggccgatcgcctgcgccgccgcgagttgcgcggccggcgtgttgccttgcgcctgcgcgacctgtgcctggtagaagatgtcgttcgcgccgccgttgaccagcacgatctggccggcgttgaagctgccgtgctgcgacaggtattgcttgacctggtcggcgatcggcgtcgtggtggcctgcgcgtagtcggcgttcggcacgctcgcgtccgcatggccgatacccggctgcagcgtcacgcgcgagccgccctgtgcgtagccgagaccgccggtggcctgcagcggaatgccgaacccgccctggttcgcgggctgcagcgtgtcgccgtagtactgcgcgacgttctgcgtccatacctggcccgggttggtcgtgaagcggccgccgccgaagccgagcttgatctgcgagtaggtgcccgcgtcggacaggctgtcgccgaacgacacgacctgcatcttcacgcccgacggcggcgtgttcgacgcgctgttgttgttgtcgtcaccgccgccgccgcatgcggcgagcagcgcgagcgcggcgccggcgatcgcgacctgcgcggtgcgcagcatgcgctgccgggtgcgggaaggtgcgtgttgttgtgtctgcatcgttcgatctcctcgtagatatggcctgatgtgtttctcatctgccgcgtgcctgctcggttccgggccgcgcggcggccgttggctgaaacggtttattggtcgcgcgcagccgcaagcggcacggtgcgcggatcggggttcgcggcctcggcaatctgcgcatgataagcgctcgcccattcgggcgggccgaaaatcgcgcgcagcttgttgcgccatccgtcgacgcgcaatgcgtcgccggccatcgatatccactcgtggaacgtcgcgacgagcgggttgttcgagccgagccgctcgacgatcccgtaccgcggcggatcgtcgggcgtttcctcgacataactcccgaacaggcgatcccagatcacaaggacgcctgcgtaattgcggtcgatgtagcgcggattgcgcgcatggtgcgcacggtggatcgacggcgtgttcagcacgtattcgagccagccgagcttgccgatcgcctgcgtgtgcacaaagaactggaacgcgaggttgatcagcacgatgccgacgacctgctgcggcggaaagccggcgaacgcgagcggcagccagaacacccacatgcccgcgacggggtacatcaggctctggcggaacgcggtcgagaaattcatccgctcggacgagtgatgcacgacgtgcgcggcccacagccagcgcacgcgatggctcgcgcggtggaacacgtagtagaggaaatcctgcgcgacgaacagcaccgcgaacgacagccagccgtcgtgccacgtgaacaggcggtagtgccggtagcaatacgcgtagacggggatcacgaacagccatgcgatcttgtcggcgccctggtgcatcagcgcgagcgccgcgttgcacagcgtgtcgcgccacgcatagacagagtcctgcgcacgggtgcgggcgaggtgccaggcctcccacgcgatgcagagcaggaagacgggcgccagcgcgagcagaagcaattcgacgtcgaatcgcatgggcgtgtctccttctttcccctgcaagccttgaggccgggcgtatggcccgttgtagatatcggtcaggccaacagcctacgcaatcgccacgcgctaggcgagggggcagcgtagagggttccctctgaggacagggtttctacggaagccgcgcggcacggggccgggcggtgtggccctgttttgtgggcgcgatcggtgcgcggcgtgtcgcgcgcggcggcggctgccgtttcaaaccggggagggcgggattccgtgcgcgggggcgcttgcgggccgccccgattgcccgtcggggcgacccgctgcgcggtgcggctccgtggccggtgcgagccggcgcgggccggcggccgacggcgccgcgccaagccgcggcgcacggatcgtcattgcgcgccggcgtagatccattcgagcagcgtgtcgtgcgcggcgcgtgcggcttccgcgtgatcgttgttgatgaaactgacgacgatgtagctctggccgtcggcgccggcaacgtagccggcgatcgcgcgcacgtcgcgcagcgtgccggtcttgatgtgcgcgttgccgagcacgccggcgttggtgaggcggttcttcatcgtgccgtcgatgcccgcgatcggcagcgaatcgatgaaggcctgcgcgacggggctcgcgttcgcggcctgcagcagcgcggcaagcgacagcgcgctcacatgctcttcgcgcgacaggcccgagccgttttcgagcacgaggtcgggcatcgcgatgccgttcttctgcaggaacgcctggatcacgcggctcgactgctcgggcgtcgcgggcggcctgccgccgaccgcgccgatcgtcaggaacaggttgcgcgccatcacgttgttgctgaacttgttgatgtcgtagacgatgctgccgagcaccgggctgtgatgcacggcgagcggccgcgcggtggtcggcaccttgccttcgctcacgggccccgtgatcgtgccgccgtcctgctgccacagcgcgaggaagccgcgggcgaagaacgtcgtgtgatcgaggatcgcgaggttggtcgtgtgcgcgccgcaacgcagcgggtagtcgccggcgaacgaagcggtcatgatcccgctgccggccgtcagcgtcggccgcgcggccgcggcggccgcgctgcacgagcccgagccttcgaccagctggttgtcgatcgacaggtccgcgagcggcggcagcacgtcgacggccaccttgccgtcgtcgcccggcgtgacggtgaacgacacggccttgaacgcgtacagcagcggatcggggccgacgttgtacggcgcgctcgcatcgtcgtcgaacgaagggagatcgcgcgtcgacgccgcgaagtagctcttgtcgagcacgaggccgccggccacgcgcttgacgccggccttgcggagcttgtcgacgaggtcgatcagctcttcgggtacgagcttcggatcgccggtgcccttgatgtacaggttgccctgcagcgtgccgtcgggatcgaccgtgccgtccgtgtacgcggtcgtgcgccagcggtagtcggggccgaggatcgacaggcccgagaaggtcgtcacgagcttcatcgtcgaggcgggcagcatcggccggctcgcattccacgcgatcagcggttccggatcgccgacgcgctcgacgacgacgctcatcgccgacgccggcaccttcgcgcgctgcagcgcgacgagcacggatgcaggcaggccggccgcgcgcgcggccggcgacacgaccgtggtcttgcgcgcttccttgtgggatttcttgcgggcctgcgcggcaggcgcgaaggcgagggccgtgcaggtggcgacgatggtggccgcccgcaggcagacgcgggcgcgggggcgaaccggttggaaagatcggaaatcggcatgagcgaatacgggaaagcacgacgttcgggcagggcgcgcgcggcgccaaagcgcacattgtagagacaagtccggacagccccttgcaatccgcctttctgttgcattgcacggtgccgcgcgccgggttcgcggcgctacaatggtcggcgtgtttgactcgccccatggatgcctgtcccgatgcggattctgcttgtcgaagatgatcgaatgattgccgaaggcgtgcgcaaggcgctgcgctcggacggctttgcagtcgactgggtgcaggacggcgacgccgcactgacggcgctcggcggcgagacgtacgacctgctgctgctcgatctcgggctgccgaagcgcgacggcatcgacgtgctgcgcacgctgcgcgcgcgcgggctggcgctgccggtgctgatcgtcaccgcgcgcgacgcggtggccgatcgcgtgaagggcctcgacgcgggcgccgacgactacctcgtcaagccgttcgacctcgacgagctcggcgcgcgaatgcgcgcgctgatccgccgtcaggcggggcgcagcgaatcgctgatccgccacggcgcgttgacgctcgatcccgcttcgcatcaggtgacgctcgacggcgcgcccgtcgcgctgtccgcgcgcgagttcgcgctgctcgaggcgctgctcgcgcggcccggcgcggtgctgtcgaagagccagctcgaggagaagatgtacggctggggcgaggagatcggcagcaacacggtcgaggtctacatccacgcgctgcgcaagaagctcggctccgacctgatccgcaacgtgcgcgggcttggctacatggtcgtcaaggaaagctgacgcgtgaggtcgattcgtcatcaattgctgatctggctgctcgcgatcgtcgtcgcgggcgtgggcatcgcgggctggctgatctaccggcaggcgctcgccgaggcgaacgaactgttcgactaccagttgcaggaaatcgccgcggcgctgccgtcggaaccgttctcgcaggtattcggctcgcgtaccaacggcgacgaaggcatcgtgatccagatctggaaccgcaacggcgtgctgatgtacttctcgcatccgcgtgcgccgatcgcgccgcgcgcggaactcggtttctcgaccgagcgcaccgatcgcggcgaatggcgcgtgtacggggcgatcgtcggcgacaacgtcgtgcagctcgcgcagccgctgtcggtgcgcaaccggctcgcggcgaacgtcgcgctgcgcacgctgtggccgctgatcgtgctgctgccgttcctcggcgcggccgtgtgggtgatcgtcgggcgcgggctcgcgccgctcggccgcgtgacgcgcgccgtcgaggcgcgccggccggaagcgctcgatccgctgcccgatgcgcgcctgccgctcgaggtgcagccgctcgtgcgggcgctgaacgggctgctcgcgcggctgtcggccgcgctcgacacgcagaaggcgttcgtggccgacgccgcgcacgaactgcgcacgccgctcgcggccgtgcagatccaggcgcaactcgtcgcccgcgcgaaggacgatgcatcgcgtcgcgaggcggtcgcggatctccaggatggcgtgtcgcgcgcgacgcgtctcacggagcaactgctcgcgctggcacgcgccgaacccgacggcgcgacgatgcgcgaacccgtcgacctgcaggcactgctcgccgaatgcgtggctgcgcttgcgccgctcgcgcagcggcgcgacatcgatctcggcttcgaggagacgcacgcggcgagcgtcgtcgcggacgtcggcgcgctgcgcgtgatgttcggcaacctgctcgacaacgcggtgaagtacacgccggacggcggccgcatcgacgtgtcgctcacccgcgacgcggccggccgcgcgtgcgtgcagatcggcgacagcgggcccggcatcccggccgacgagcgcgagcgcgtgttcgaccgtttctaccgcgacagctccgcgcgggcgcgcaccgatgtgtcgggcagcgggctcgggctcgcgatcgtcaagcgcgtggcggcgcagcagggggcgacggtgtcgctcggcgacgcggccgcgggcggcctgctcgtcagcgtcgtgttccgcgacgccgagatgccggccgaggcgccgcagccttccgaatccgcgtgacgtgtgccgccgggcgggcgccggcggccgcttaagccccgcttaaggctgattaagcctcctttaagtcagggtcgttacgctgcgtcctaacaaagaggaggtcctacgatgaacacccgattccttgcgcgcggcgccgtcgcggtcgccgtggcggccgccctgtccgccggttatgttgccggcacccgccgcgccgatccgcagatcatcacgcccgcgcaggctgccgcgctgatgccggccgaagcggccgccaagaccggcattcccgatttctccgggctcgtcgagacttacggcccggcggtggtgaacatcagcgcgaagcacgtcgtgaagcaggtgtcgcggcgcgtgccgcagccgcaactgccgatcgatccgagcgatccgttctaccagttcttcaagcacttctacggccaggtgccgggcatgggcggcgacgcgcaaccggacgaccagccgagcgcgagcctcggttccgggttcgtcatcagctccgacgggtacatcctcaccaatgcgcacgtgatcgacggcgcgaacgtcgtcacggtcaagctgaccgacaagcgcgaatacaaggcgaaggtcgtcggctcggacaagcagtcggacgtcgcggtgctgaagatcgatgcgagcggcctgccgaccgtgaagatcggtgacccggcgcagagcaaggtcggccagtgggtcgtcgcgatcggctcgccgtacggcttcgacaacacggtcacgtcgggcatcatcagcgcgaagtcgcgcgcgctgccggacgagaactacacgccgttcatccagaccgacgtgccggtgaaccccggcaactcgggcggcccgctgttcaacctgcagggcgaggtgatcggcatcaactcgatgatctattcgcagacgggcggcttccagggcctgtcgttcgcgatcccgatcaacgaggcgatcaaggtgaaggacgaactcgtgaagacgggccacgtgagccgcggccgcctcggcgtcgccgtgcaggggctgaaccagacgctcgcgagctcgttcggactgcagaagccggacggcgcgctcgtcagctcggtcgatccgaacggcccggccgcgaaggccggcctgcagccgggtgacgtgatcctgtcggtcaacggctcgccggttgccgattcgacgtcgctgcccgcgcagatcgcgaacctgaagccgggttcgaaggccgacctgcagatctggcgcgacaagtcgaagaagtcgatcagcgtgacgctcggcgcgatggccgatgcgaagctcgcgtcgaacgacggcgggcccgtcgagcaggggcgcctgggcgttgcggtgcgtccgctgtcgccgcaggagcgcagcgccgacaacctgtcgcacggcctgatcgtgcagcaggccggcgggccggccgccaacgcgggcatccagcccggcgacgtgatcctcgcggtcaacggccgcccggtcacgagccccgagcagttgcgcgacgcggtcaagggcgcgggcaacagtcttgctctgctgatccagcgcgataatgcccagatcttcgtgccggtcgacctgagctgaccggccacggccgacggccggcctggccggccgcggcgggcgccgccgccgctcgaatgcgtgacgcagcgccctgtatgtgttccgaccccaaggagagagccatgcaatatctacgcaacgtgtcccgatttgccgtcgccgcggcgctggccgccggcctcgcggccggagcgaccggcgcgtacgcgcagtcggacggcttgcccgccgcgggccagcagggcgacgtcaccttcgtgtccggcggcgtcgggcaggacgaatcgacggcgttccagcgcaacgagccgaaatggccgctggcgctgcgcttcaccggcaagggcggcgagttcctggccgacgttcatgtgcggatcgtcgacggcaagggcgacgaggtgctgaagaccgacgcgcgcgggccgtacatgctcgtgaaggtgccgccgggccgctatacggtgcatgcgtcgtaccagggcaacgaggaatcccgtgccgtcacggtcggcgcgaagggcggcgcgaagacggcgttccagtggagcgcgcagtagcctgccgcgcgcggcgccggcccgggtcgcgcattcggctgcggtttcgcccataatgaaagccacggcacccgtgccgtggcttttcgtttcctgagcccggcctgcccgggtcgtcccaaggagaaacgatgtccgacgcagccgaccctcgtctcgaaatcgtgccgaaccgtcatcgcgtgcgcgtgatccatcgcggcatcacgtacgccgattcgcacggcgcgctgaccgtgcgcgaaacgggcctgccggacacccactacctgccgcgccgcgacgtcaacatgcgccggctcgtgaaatccggtgtcacgtcggtctgcccgttcaggggcgaggccgtgcacttcgatttgcagacggaagacggcgtgatcgagaacgccgcatggagttacgaggaaccgaagggggcggcgtcggcgctcgcgctctacgtcgccttcgacgccgcacggatcgacagtctcgtcgagacatcctgatgcggcgcgtgttcatcggggaggcgtcatggaactgaacgacacattgcgcataccgctcgcgccgcccgtcgtgcgggaggcattcgaggatctcgcgctgctgcgcgcgagcttcgatcattgcgaatcgttcgtgaagcttgcggacggcgagttcgcgctgacgatcacggtgccgctcggcccgctgcgcgcccgctacgacgtgcgtgcgcatgcggccgccgagcagggcgatgcggaaggtcagccgcgccgcgtgctcaatttcaaggcgcgggccgacggactcggcgcgctgcgcggccaggtcgaactcgtgctgatgccggatgacgacgcgaacgccacgcgtatcgagtacgtggtctgggcgacggcgagcggcccgctcaccgagctgccggggcggcagatcgaaaatacgctgcgcgaatggaccgacgatttcttccgtgaattctgcgcggtcgtacaggcgaagcacggcctcgcaccgaatcgcgcgcgctcggccgcgccgcggcgccaacacgtgttcctgcggccggcgtcgctggtggccgcgacgaagcgggcgctgccgccgcacctcggcggcgcgctgaccgggcgtgccgccagtgcactcccgcatcgcggctcgggcacggtgcccgtgcgggcgtgggccgcgatgatcgtcttcgtcgcgctgctgctctacgcggcgcgctggatcaacggcggctgagcggccggccgtttccgctgcaaggctcgcccgccgcgcgcctaccgcgcgcctaccgcgcggcatcggcgccggctccggcgccgcgaaattcccttcgatacgccgacggcgacgtgccgagcgcgcccgcgaaatgctggcgcagcgacacgctcgacccgtagccggccgcctgcgcgatcgcatcgatcgactgcccggtggtttccagcagatgctgcgcgcgcgccagccgctcggcctgcagccacgcggtgacggtcgtgccggtcgcctggcggaagtggcgcgtgaacgtgcgccggctcatcagcacgcgttcggcgagcgaatcgacgctgtgcgcggcgtcgaggtgcgcgcgcacccagtcgagcaggcccgcgagccgcgcatcgcgcgggtgcgcggcgaccggctgcggcacgtattgcgcctgcccgccctgacggtgcggcgggatcacgaggcggcgcgcgatctggttcgcggcgtccgagccgaagcgccgccgcacgacgtgcaggcagcagtcgagccccgcggccgtgccggccgacgtcatcaggttgccgtcgtccacgtacagcacgtccggatcgagcttcacgcgcgggaagcgttgtgcgaagtcgtcggcccatgcccagtgcgtggtggccgggcggccgtcgagcaagccggccgcggcgagcacgtacgcgccgaggcacagcccgacgagttgcgcgccgcgcgcggcgaccgcacggacggcgtcgagcagcacgtcgggcggcgcttcgtccgggtcgcgccacgcgggcacgatgacgatgtccgcgtcgtcgagcccgtcgaggccgtagggcgcggtgatcgtgaaaccgcccgtcgtcgacagggggccgcgctcggccgagcagacgcggaactcgaacgcgggcgacgcggccgcgtcgcgttccttgccgaacacgacggacggcaccgacaggtggaacgggctgatgccgtcgtacgcgatcacggcaacgacggtcggagcggtcggggcgggccgggtggacgaggcggcggtcatggcgggctccggattggtgatggcccgattctatcgaagaatggctatcgggccactgtccacgtgagcgacgcgccccgacaatgcatcgcatcgcgccgctgaccaccccgttccggggcggggccgcgccctggaccaggagcccgccatgtcgaacgccgtcccgcattccgtttcccattccgctacccgccgcgcgctgatcgtgatcgacgtccagaacgagtacgtgacgggcaacctgccgatcgaatatccgccgctcgacgtgtcgctcgcgaacatcggccgcgcgatcgatgccgcgcatgcggccggcgtgcccgtgatcgtcgtccagcacgtcgcgccggccggcgcgccgatcttcgcgcccggcaccgacggcgtcgcgctgcacgcggtcgtcgccggccggccgtacgcacacctgatcgagaagacgcgcgcaagctcgtttgccgggaccgaccttgcggcgtggctcgatgcgcacgggatcgacacgctcgcggtggccggctacatgacgcacaactgcaatgcgtcgacggtctatcatgctgcgcatgcggggctgaatgtcgaatacctgaacgacgcgacgggcacgctgccttacgagaacgaagcaggcgcggcgagcgccgaggagattcaccgcgcgtacgcggtggtgttccagtcgaatttcgcggccgtgatgtccaccgatgcgtggatcgcggggctggaaggtgcgccgatgccgaagcgcgattcggtcgccgcgtcgaaccggcgggcccgcgcgcaacgcgcgaaggcggcctgaaccgggcggggagaaggggcggcgggcaggccgtcggcgagattggcggcccgcgcgatgaaacgaagccccgaaccgcgggcgaacgcgcgtcgcgcggtcattcgccgtccttcagcatcgccgggctgtagcgcagcatgtcgaaacagccgtcgacgagcttttccgcatgctgctcggcgtcgatctcgtcgggcagcatcagcatgtcgcgcacgaaaccgctgacgagcgtgtgcagcatcaacgtcgcgcgccacgtatcgagccgctcgggcagcagcttgagccgcacggcccccgcgagatcggcgtcgatcgcgtgcagtgcctcgctcatccccgcgcggttgcgctgcagcagtggctccaggtccgcgacgtattcgcacttcatgaacaggatgctgaacacgcggcgcaactgcgcgtcgcgctgcacgccgagcaggcaccagatcaggatctggcggatcttgtcgagcggattgccgcccggcgcgtcgagcggcatccgcttcaactcgtcgatcggcagaaacacgcggtcgaacattgcgtcgaacagttcgctcttgttcgcgaaatgccagtagattgcgccgcgcgtcacgccggcatgttgcgcgatgtccgcgagcgacgtgtgcgacacgcctttctcgaagaacacgtgctcggcggcgtcgagaatgcgattgcgcgtctcgagcgcctcctccttggtacgtctgaccatgtgcaggcctgattggatcgatcgtaggtgaatatagggtctgcaaccctcggcgcggtcatatagactggctatgctcgcggctggtaacaatctgtaagactggacagccggtcgcgcacaaacgggctttttacatacattcatgaatgtatatacaataccaccctacgatcgaatgacccaagtggcaatcagttaatatcccactctgctgattcccgccaaagtaccagtccgcagttgcgggcatcctgtcggcacggaggtttcgtgccgcttgctgtatctagcagtccagtaattcaggtgttcgatctgcgccgtgaggcgcatccgtgttgcgctcgctccggtcgggtgcggcacttattccattggttatacacagaggtcgctccatgcgcgtcgaacgggttccataccgcttaatcactgtcgcgacggccgccgttttcctggccgcgtgcgggaaaaagaatcggcaccgccgccgcaaacgccggaagtcggcgtcgtcaccgtccagccgcaagccgtaccggtcttcaccgacctgccgggccgcaccagcgcgttcctcgtcgcgcaggtccgcgcgcgggtcgacggcatcgtgctgcgccgtgaattcaccgaaggcaccgacgtcaaggccggtcagcgcctctacaagatcgacccggcgccttacatcgccgcgctgaacagcgcgaaggcaacgctcgcgaaggcgcaggcgaacctcgtcacgcagaacgcgctggtcgcacgctacaaggtgctggtggccgcgaacgcggtcagcaagcaggactacgacaacgcggtggccacgcaaggccaggccgcggcggacgtcgcggccggcaaggcggcggtcgataccgcgcagatcaacctcggctataccgatgtcgtgtcgccgatcaccggccgcgtcggcatctcgcaggtgacgccgggcgcgtacgtgcaggcgagccaggcgacgctgatgtcgacggtgcagcagctcgacccggtgtatgtggacctcacgcagtcgagcctcgaagggctgaagctgcgccaggacgtacagagcgggcgcctgaagacgtccggcccgggcgcggcgaaggtgtcgctgatcctggaagacggcaagacctattcggagccgggcaagctgcagttctcggacgtgacggtcgaccagaccaccggctcggtgacgatccgcgcggtcttcccgaacccgggcaaggtgctgctgccgggcatgttcgtgcgtgcacggatcgaggaaggcgtgaacgagaacgcgttcctggtgccgcagatcggcgtcacgcatgaccagaagggtcaggcgatcgcgatggtggtgaacgccagcaacaaggtcgagccgcgtccgctgaagacgacgggcatgcagggcccgaactgggtggtcgaaggtggtctgcaagcgggtgatcacgtgatcgtgcagggcgccgacaaggtgcgcccgggtgcgaccgtgaagacggtccccgcgcagctcgcaccggcggccgatgccgcgtcgggtgcggctgccgcgtccgccgcgccggctgccgccggttccggcgccgctgccgcttccggtgctgccgcatcgggcgctgcgccggcgagtgctgccgctgcttcgagcgcgcaataacagggagcctgtttcatggcaaagtttttatcgatcgcccgatcttcgcgtgggtgatcgccatcatcctgatgctggccggggttgcggcgatcttcacgctgccgatctcgcagtatccgacgatcgcaccgccatcgatccagatcaccgcgaactacccgggcgcttccgcgaagacggtggaagacacggtgacgcaggtgatcgagcagcagatgagcggtctcgacaacttcctgtacatgtcgtcgaccagtgacgactcgggcaacgcgacgatcacgctgaccttcgcgccgggtaccaacgccgacatcgcgcaggtccaggtgcagaacaagctgtcgctcgcgacgccgatcctgccgcaggtcgtgcagcagctcggcctctcggtgacgaagtcgagcagcagcttcctgctggtgctcgccttcaactccgaagacggcagcatgaacaagtacgacctcgcgaacttcgtggcgtcgcacgtgaaggatccgatcagccggttgaacggcgtcggtaccgtcacgctgttcggctcgcagtacgcgatgcggatctggctcgacccgaaccgcctgacgaactacggcctcacgccggtcgacgtcagctccgcgatcaccgcgcagaacgtgcagatcgcgggtggccagatcggcggcacgccggcgaagccgggcacgatgctgcaggcgacgatcaccgaatcgacgctgctgcagacgcccgagcagttcggcaacatcctgctgaaggtcaaccaggacggctcgcaggttcgcctgaaggacgtcgcgcagatcggcctcggcggcgaaaactacaacttcgacacgaagtacaacggtcagccgaccgcggcactcggtatccagctcgcgaccaacgcgaacgcgctcgcgaccgcgaaggccgtgcgcgcgaagatcgacgaactggcaccgttcttcccgcacggcctcgtcgtgaagtacccgtacgacacgacgccgttcgtgaagctgtcgatcgaggaagtggtcaagacgctgctcgaaggtatcgtgctcgtgttcctcgtgatgtatctgttcctgcagaacctgcgggcgacgatcatcccgacgatcgcggtgccggtcgtgctgctcggcacgttcgcgatcatgtcgatggtgggcttctcgatcaacacgctgtcgatgttcggcctcgtactcgcgatcggcctgctggtcgacgatgcgatcgtggtggtggagaacgtcgagcgcgtgatggcggaggagggcctgtcaccgaaggaggcgacccgcaaggcgatgggccagatcaccggcgcactggtcggcgtggcgctggtgctgtcggcggtgttcgtgccggtggcgttctcgggcggttcggtcggtgcaatctatcgccagttctcgctgacgatcgtgtcggcgatggtgctgtcggtgctcgtcgcgttgatcctgacgccggcactgtgcgcgacgatcctcgccgatcccgcaagggcatcacgaagagaagaagggcttcttcggctggttcaaccgcacgttcaacaacagccgcgacaagtaccacgtcggcgtgcaccacgtgatcaagcgctcgggccgctggctcatcatctatctggtcgtgatcgtcgcggttggcctgctgttcgtgcgcctgccgaagtcgttcctgcccgatgaagaccagggcctgatgttcgtgatcgtgcagacgccgtcgggttcgacgcaggaaacgaccgcgaagacgctcgcgaacatttccgactacctgctgaaggacgagaaggaaatcgtcgaatcggcgttcacggtcaacggcttcagcttcgcgggccgtggccagaactccggtctcgtgttcgttcgcctgaaggactactcgcagcgtcagcatgcgaaccagaaggtgcaggcgctgatcggccggatgttcgggcgctactcgggttacaaggacgcagtggtgatcccgttcaacccgccgtcgattcctgaactcggtacggctgccggcttcgacttcgaactgaccgacaacgcgggtctcggccacgatgcgctgatggccgcgcgtaaccagctgctcgggatggcctcgaaggatccgacgctgcagggcgtgcgcccgaacggcctgaacgatacgccgcagtacaaggtcgacatcgaccgcgagaaggcgaacgcgctcggcgtgacggcggatgcgatcgaccagacgttctcgatcgcatgggcatcgaagtacgtgaacaacttcctggataccgacggccggatcaagaaggtgtacgtgcagtcggatgcaccgttccggatgacgccggaagacctgaacatctggtacgtgcgcaacgggtcgggcgggatggtgccgttcagctcgttcgcgaccggtcactggacgtacggttcgccgaagctcgagcgctacaacggcgtgtcggcgatggaaatccagggtcaggccgcaccgggcaagtcgaccggtcaggcgatggccgcgatggaagggctcgcgaagaagctgccggtcggtatcggctattcgtggaccggcctgtcgttccaggaaatccagtccggctcgcaggcgccgatcctgtacgcgatctcgatccttgtcgtgttcctgtgtctggcggcactgtatgaaagctggtcgatcccgttctcggtgatcatggtggtgccgctcggcgtgatcggtgcactgcttgcggcgacgatgcgcggtctggaaaacgacgtgttcttccaggtcggcctgctgactaccgtgggcttgtccgcgaagaacgcgatcctgatcgtggagttcgcgcgcgaactgcagcagacggagaagatggggccgattgaggccgcgctggaagcggcgcgcctgcggctgcgtccgatcctgatgacgtcgctcgcgttcattctcggcgtgatgccgctcgcgatcagcaacggcgcgggttcggccagccagcacgcaatcggtacgggcgtgatcggcgggatgatcacggcgacgttcctcgcgatcttcatgatcccgatgttcttcgtgaagatccgtgcgatcttcagcggcgagaaggaagacgtcgacgaggcgctgcgcctggctcaggagcactcgcaccacgaagagaagccgggcaacggcgacgaaggcaacaagggacagtgatgatgcaaaaacacgctttgactgcaatcgcggtcgcgctctttgccacgggctgcacgatggcgccgcattacaagcggcccgacgcgcccgtcgcacaggcgtacccggccggcggcgtctacgcgacgcagccgggtgcggccggcgcgcgcagcgcgaacggccaggcggcgaccgccatcggctggcgcgaattcttcgtcgatccgcgcctgcagcggctgatcgagatcgcgctgaagaacaaccgcgacctgcgcgtgtcggtgctgaacatcgaggcggcgcgcgcgcagtaccagatcacgcgcgcggagctgttcccgacgctcgacggtacgggcacgggcagcatccagcgtttcccggccggcgtgtcgtcgacgcgggcgccgttgatctcgcgcagctacaacgtcgggctttccgcgtcgtgggagctcgacctgttcggccgcgtgcagagcctgaaggaccaggcgctcgcgcaatacctgtcgacgtcgtacgcgcggcaggcgtcggagatctcgctggtatcgcaggtggccgatcaatacctgacgctgctgtcgaccgacgatttgctgaaggtcacggagaacacgttgaagtccgctcaggcgcagtacgacctgacgaagctgcagttcgacaacggcacgggctccgagctcgagctgcgtcaagcgcagacggttgtcgagacggcgctcgcgaaccagcaggcgcaggcgcgtgcgcgtgcgcaggcgctgaacgcgctggtgctgctgatcggcgagccgctgccggacgatctgccgccgggcatgccgctcgacgcgcagaacctgctgacggacgtgccggccgggttgccgtcggacctgctgacgcgtcgtccggacgtgatgcaggccgagcagacgctgctggccgcgaacgcgaacatcggcgcggcacgcgctgcgttcttcccgaagatctcgctgacggcggcgttcggtaccgcgagcccgacgctcggcggcctgttcaaggccggcacggcggcatggtcgtttgcgccgagtattgcgctgccgatcttcgagggcggttcgaacatcgccaatctcgatctcgcgcacgtgcagaaacgcatcgagatcgcgaactacgagaaggcgatccagtcggcattccgcgaagtggcggacggtcttgccgcacgcggcacgtacgaccagcagatcgcggcgctcgagcgcaacgagcacgcgcagcagcgacgtttcgacctgtcggacctgcgttacaagaacggtgtcgacagctacctgtcggtgctgaccgcgcagacggatctgtactcggcacagcagacgctgatcaacgcacgtctggcgcgctggacgaacctcgtcgacctgtaccgcgcactgggcggcgggtggattcagcgggcaggcgagacgccgcgcgcgccggatgcgccggtcgactacgacaaggcggccgctccggcgcctgcgtcgtcggcggcgacgaacgggtaagtgaaaggcggggcaggagcgggcaactgcttctgcctgccgaaccggcgagatgcaaagcgaaaacgccacggatgaaaatccgtggcgttttctttgtgcggccgggtcgtgcgagaccacgacggttggcgtgacgatgactgcatcggatgccgccgatgccgatcacggcagatacgcgtccaggcgcgatcacccgatcaaccaggccgcctgcaccgcatcgcaggcggccaccctgagcgcgcgaggcaccccgcgtaacccggctccgccagcaaaaacgccacggcatgccgtggcgttttccgttaccgcttcgcgccgtcgtccggcgcgtcgtgatcagtgatgcacgtcggccgggcggccgtcgaagtcgtgtccggcgcggcggatctcgcagcgcgcatcctttcgcctttcacgccgttgaacacgatgttcaggatcacggccgatgccgacgccagcaggatgccgctgtgcaggatcggggcgagcgcgggcggcagcttcgagaagaagtgcggcgacacgaccggcacgaggcccatgccgacgctcacggcgacgatgaacaggttgtgcgagttgttcacgaagtcgaccttcgacagcaccttgatgccgttcgcggccaccatcccgaacatcacgatgcccgcaccgccgagcacgaacggcggcaccgatgcgaccacctgcgccatcttcgggaacaggccgagcagcacgagaatcacgccgcccgtcgcacacacgaaccggctcttcacgcccgtcacgccgatcaggccgacgttctgcgagaacgacgtatgcgggaacgagttgaagatgccgccgatcagcgtgccgaggccgtcgacgcgcaggccgcgcacgaggcgctcctggttgaccggacgatcgaccatgtcgccgaccgcgaggaacatgccggtcgattcgatgaacgtgacgaacatcaccgtgaccatcgtcacgatcgacagcgggtcgaagtgcggcatgccgaagtggaacggcatcacgatgccgacccacggtgcgtgcgcgacgccgtcggtattcacgcggccgatcgcgaacgcgatcgcgaagccggcgacgatgccgagcagcaccgagatgttcgcgatgaaaccgcggccgaacttgttgatcagcaggatcagcgtcagcacgagcagcgacaggccgagatagacggggctgccgtactcggggttgccgacgccgccggccgcccagttgatgccgacttccatcagcgacagcccgatcaccgcgatcacggtgccgaccaccaccggcgggaagaaccgcaacagcttgccgatcatcggcgcgagcacgatgccgatgatgcctgccgcgatcgtcgagccgaagatgtcgagaatgccgaggccggggttcgtgccgatcgcgatcatcgggccgactgccgcgaacgtgcagcccatgatgacgggcaggcggatcccgaagatccacaggcccagcgtctggatcagcgtggcgatgccgcacgaaaacagatcggcgctgatcaggaacgcgatctggtctttcggcagcttgagtgcggcgccaacgataagcggcacggcaacagcgccggcgtacatgacgaggacgtgttgcaggccaagcgttaccagcttgccggtcggcagcacctcatcgcacggatggaccgtgttcgattgcatctgtctcactccatgatcttgttttcggggtgatacgaagttatgcggaatgaatccacgcaacaagagcgctgggtactattccgctctttgctggttcgatatgccatttcggcatgaaacagggtgtcgatcatcgggaaactgccgcaggagtgagggttcccggttttatagcccttcaaaatagcgctggcccccatgtcaaatatcggccgctttatggtgtgtatcgggcggggcgcatagcggcaaaaagtgcctgggaaaaatcgtgccgggttaacccgcgagcggccgctttcaccgccaacgtgcagccgggtgaaatccggcaggccatggtgatttcggccggcgcggcggcggcaaagacggggcgcgcatcgcgatcccgttatcatcgacatccgttcattcgaattcgccctcacgtcatgcgcctgctcggaatcgacctcggcaccggctccgtcaaactcgtcacgctcgatgccgacggcgtcgagcgtgcggtcgcgagcgaaccctatgcgctgtcgtcgccgcagccaggctgggccgagatcgcgcccgacacgtggtggcaggcgctggtgcgcgcggccgcgcggttgccggccggcgagcgtgcgcaggtggcggcgatcgggttctcggggcagatgcacggcgtcgtgctgatcgacgcggccgggcagccggtgcggcccgcgctgctgtggcccgacacgcgggcggtgcgcgaagcggacgaggccggctggcccgtcacgggatcgcccgttgccggatcgcccgtcgccccgaaccccgtcgcgccgggtatggccggcccgctgttgcgctggctggccgctcacgaacccgatgcgctgcgcgccgcgcgctgggccgtgcagccgaaggactggttgcgcatcgcgctgggcggcgacgtcgcggccgatccgagcgacgcgtgtgcgaccgcgctcacgacgcccgacggcgcatgggatctcgcattgatcgacgcactcggcctgccggccgaccgattcgcatcggtgcagccgtcgactgcgcgctgcggcacgctcggcgcaccggctgcggcggcactcggcctgccggccggcgtgccgctggcgacgggcgcggccgacaccgcatgcgcggccctcggcagcgggctcgccgccgccggcgatgcgctgctgacgacgggcagcggcggccagatcgtcgtgctcgccgatgtgctgccgcccgcgcgacgcgggctgcatcgctatcgcgcggcggccggcggcggttattacacgatggccgcgatgcagaacgtcgggctcgcgctcgaagccgtgcgcggctggctcggctacgcgcagtgggccgatgcgtacgacgatgcgttcgcgcaggctgcgtcggaacgtctgtgcttcctgccttacctgacgggcgagcgttcgccgtggatgaaccccgacgcgcgcggcggctggctcggcctcgggctcggcgacacgcgcggcgcgatgatgcgcgccgcgttcgaaggcgtcgcgttcgcgttgcgcgccgggctcgatgcgatccgcgatgccgaccgcggcgacccggtgacgacgctgcgtctcgcgggcggcggctcggtcgatccgcgctggcgccagctgcttgccgactcgctgggcgcgtcgcttcacgcgatcgactgcccgaacgccgcgacgcgcggcgccgcgctgctggcgggcgtcgcgatcgggcactggcgggaagacgcgctgcacgtgctggcgccggccgcgtcgccggttgccgagccgcgcgacgatcgctcgctggccgcacgccacgcgcgcttcgtcgacctgtatgcccggacggatgcatggttcacgacgggcgcttaaaatcgggcacttgttcttttgcgtcagcgatgacgcatcgtggcaagccggcggccgtttcccgcacgcgatgcgcggcggaaccggccatcatggcgagcacgagattctttcgccgtgctgcgcgcgacaccgcgcggcacggtttcgaccgctttgcatggaacccggtgcgaagcattgggccggcgtcggtgctggcgcacccaggccggtcgacatgagcgccgacgcgcgaacccgggccgacctcacacacagacaggagtcacacgatgaagacgaaagccgcgattgcatggaaggcgggcgcaccgctgacgatcgaggaagtcgatctcgaagggccgcgcgcaggcgaagtgctgatcgaggtgaaggcgacgggcatctgccacaccgactactacacgctgtcgggcgccgatccggaagggatcttcccggcgatcctcggccatgaaggcgcgggcgtcgtggtcgacgtcggccccggcgtcggcaccgtgaggaagggcgaccacgtgattccgctctacacgcccgaatgccgcgagtgcaagttctgcctgtcgcgcaagaccaacctgtgccagaagatccgcgcgacgcagggcaagggcctgatgcccgacgcgacgtcgcgcttctcgctcgacggcaagccgctgttccactacatggggacgtcgacgttctcgaactacatcgtcgtgccggaaatcgcggtcgcgaaggtgcgcgaggacgcgccgttcgacaagatctgctacatcggctgcggcgtgacgacgggcgtcggcgcggtcgtgtactcggcgaaggtcgaggccggcgcgaacgtcgtcgtgttcggcctcggcgggatcggcctgaacgtgatccagggcgcgaagatggtcggcgcggacaagatcatcggcgtcgacatcaacccgaagcgcgtcgagctcgcgaagaagttcgggatgacgcacttcatcaacccgaacgaagtcgagaacgtggtcgaccacatcgtgcagctgaccgacggcggcgcggattactcgttcgaatgcgtgggcaacgtgaagctgatgcgccaggcgctcgagtgcacgcacaagggctggggccagtcgttcatcatcggcgtggcggcagcgggcgaggaaatcagcacgcgtccgttccagctggtgacgggccgcgagtggaagggctcggcgttcggcggcgcgcgcggccgtaccgacgtgccgaagatcgtcgactggtacatggaaggcaagatcaacatcgacgacctgatcacgcatacgctgccgctcgagcggatcaacgaaggcttcgacctgatgaaggccggcgagtcgatccgttcggtcgtgctgtactgaccgggagcgcaccgcgatgctcgaactcgtttcctcgcatgcgtgccacggcggcgagcagcgtttctaccgtcacgattcggcggccatcggcctgccgatgaagttctcggtgtacctgccgccgcaggccgcgcacggccgcgtgccggcgctgttctatctcgcggggctcacgtgcaccgacgagacgttcgcgatcaaggccggcgcgcagcaatacgcggcgcagcacggcatcgcgctcgtgatgccggacacgagcccgcgcggcgcgggcgtgccgggcgagaccgacgcgtgggacttcggcgtcggcgcgggcttctatgtcgacgcgaccgaagcgccgtggtccgcgcattaccggatggagtcgtacgtgacgggcgagctgcgcgaactcgtcacggccgaactgccgatcgacggcgcgcggctcgggatcttcggtcactcgatgggcgggcacggcgcgctgacgcttgcgctgcgtcatcccgggctgtaccggtcggtatcggcgttcgcgccgatcgccgcgccgacacgctgcccgtggggcgagaaggcgttctcgggctacctcggcgccgatcgcgatgcctggaaggcacacgacgcgagcgaactcgtcgcgcgcgccgacgcgccgaagttcgcggacggcatcctcgtcgatcagggcctcgcggatcagttcctcgcgaaccagctcaaccccgacgtgttcgaagccgcgtgcgcgaaggccggccagccgctgacgctgcgccgccatccgggctacgaccacgggtactacttcatctcgacgttcatcgccgatcacatcgcgcatcacgcgcgcgtgctcgcgcgatgagcgggaagggagcacataacgcacacggcggcacgcggcgcgccgcacgagcgggtgcaaaaacgccggcgctgccctcgggcacgccggcgtttttcatggtcgtcgggcgtcgatcagtggcgccgcaacaggcttgcgccgtacacgagcgccgacagcgcggtgatccagaaactcgtcggccagtcggtgtgatacgcgagcacgatgccgagccatgcttcgaacaacgcaaacagcgcggcgagcagcacgccggtcgacagccgcgtcgtcacgttctgcgcggcggcagccggcccgaccagcagcgtgaacaccagcagcacgccgacgatctgcgtggccgccgccacggcaagcgcgcacaccgcgaggaacagcatcgacaccgtgcgcagcgacacgcccttggcttcggccagttcgggctgcagcgacgcgaacagcagcggccgcgcgatcagcgcgagcgcgagcaggctcacggcgccgatgccggcgagcaccgcgagcgtgtcgtggctcaccgcgagcacgttgccgaacagcagcgcggtgacctgcgtcgcgaacgatgtgtagaaatgcaggaacagcaggccgaaacccagcgcacccgacaggatcacgccgatcgcgacgtcgcggcccgcgagcttttcgccgagcgcgcccatcccgatcccggccgcgagcgtgaaaccgaccatccccagatcggcgagatgccgagcagcaccgcgcccgtcgcgccggtgaagccgacgtgcgacagcgcatggccggcgaaggtctgcccgcgcagcaccaggaagtagccgacgatgcccgcgagcaccgcgacgatccccgacgccgcgaaggcgttgatcatgaagtcgtattcaaacatcgtgcgagtgcccgggatgagcgtgtccgtggtggtgatggccgtggccgccgccaccgccaccgccatgcgagtggccgtcgtcgtcctcgtgttcgtggtcgtgcttctcgatctcgacgtcgcccgacatcacgaagatcttgccattcacgcgcatcacgtcgatcggcgatccgtagagccgcgacagcacgggcttcgtgatcacctcgtcgacggtgccgagcgccgcgacgccgttgccgagatacagcacacggtcgagcgcgttcagcaacggattcagttcgtgcgcggagaacagcacggtgatgccgagctcgcgctgcacgttgcgcacgagctcgacgacgccgcgctggtggttcgggtcgaggctgatcagcggctcgtcgagcagcagcagcttcgggctgccgagcaggcattgcgcgagcagcaggcgctgccgctcgccgccggacagttccgacagcggccggcgggcaagcgtcgggccgccgacgagatcgagcacgcggtcgacgtcgcggcgcgtcgccgcgttcgtgtgcggcagccccagcggtggccgtcggcggccatcgcgacgaagtcgtagccgcgcatccggcggttcgcgaggccgctgcgaatctgcggcatgtagccgatcgacgggttgccgcgtacgaccggcacaccgccgacggacagcgtgccggccgacacgggcacgaggccgagcaccgcgcgcatcagcgtcgtcttgcccgcgccgttcggcccgagtacgccgacgaattcgccgggttcgatcgcgaagctgacgtcgcgcaggatcgtgcgtccgcccagttcgagcgtgacgcgatcgacggcgagtgcgtggggagtggcggtcatggcgttacggttgtttatttcttgccggcggcgagcgcggccgagagcgcgtcgagctggccggccatccattgctggaaagtcttgccggccggctgcgtctcggtgacgctgacggtcggcacgccgccgtcgcgtgcgatcttcagcatgcgcttggtcatcggttcttcggcctggctgttgtagatcagcgcgcgtacctgcttcttgcgcaggtcgttctcgaacgcggcgacgtcctgcgcgctggcctcggtgtcgttcatcgtcgcgagctggaagcgctggttgcgcatatcgaggccgatcgcgtcggacaggtagccgaacaccggctcggtggccgtcaccggcacgcccttgtactgcgcgcgcagcgcggcaaccttgtcgtcgacgggcttcagcgacgcgacgaacttctgcaggttcgcatcgtattcggccttgttcgccggatcggcgcggccgagttcggccgcgatcgcgcgtgcggcggccggcatcgtcgccgggtcgtaccacaggtgcgggttgtcgccggccttcttgccgaccaggtcggcgacgacgatcgtcgcgcgcttcgcctgcttcgacgcgccgagcagcttgctcatccacggatcgtagttcgcgccgttgtagatcacgacctgcgcgtgctggagcgcgcgggccgtcttcgggctcgcttcgaacaggtggggatcctggtcgggattgctgaggatgctcgtcaccgcgacatggctgccgccgatctgcgacgcgacgtcgccgtagaaattctcggcggcgacgacgttgacggtcgcggcctgcgcgaacgcgggcgccgcgagcgacagcgcggcgaccgtggagacggcagcggcgagccagcggacaggcgtcagggcgcgccgcggcgcgcgcttcagggcaatgggcatggaactcctcgttggaagggcggcacgtgtgccgcccgatacgcgtcagcgttgcgcgggcttgcgcttgcagtgtccgcacaggccgctcagctcgacgacctgatggtggacttcgaaaccgtgcgcgggctcgctcgcggacaactgcttcgcgaggtcgccgccgggaatctcgacggtgtcgccgcacgaatcgcagatcaggaactggccttcgtgcgggacgccgatctcgcagcacgcgaagaacgcgttcttcgattcgatccggtggatgaagccgtgctcgacgaggaaatccagcgcgcggtagacggtcgtgggcggcacgcggccgcgctgcggctcgagctcggcgagcaggtcgtacgcgccgatcgggcgctgcgcggccagcacgcgttcgtagacctggcggcgcagcggcgtccacgcgagcccgtgctcggcggcgaatgcgtcggcccgggacagccgggcgtcaatggacgatgaggtagccatggcgtgaagctgggcgtgaaacaaagtatggcgatgatataacgtatcgccgcgccgtgcagcgcgaattcccctttcgtcgtcgctccgtccccttcatcgccgatccgaccgcgccgcaccgcgcgcgccgcgccttgccgggcgcgcgtggcgggccgccgcggtgcgccgttgtgccgcagcgcatcatagaaagccgtcatgttgccttgacagcgcgaatcgcgtatccgatcattcgatcaacaacagagcaattgatcggttggcgagcgttagttcatctcgcggccgtcgtaaagcagaacgaaccggagacagccagtgagactggaagacaaggtcgcgatcctgacgggcgccgcaagcggcatcggcgaggcggtcgcgcaacgctatctggacgagggcgcccgctgcgttctcgtcgacctgaagcctgccagcggctcgctcgcgcggctcatcgaagcgaaccccggccgcgcggcggccgtcaccgcggacgtcacgcgccgcgacgacatcgagcgcatcgtcgccacggcggtcgagcgcttcggcggcgtcgacatcctgttcaacaacgcggcgctgttcgacatgcggccgatcctcgacgaatcgtgggacgtgttcgaccggctgttcgcggtcaacgtgaaagggctgttcttcctgatgcaggccgtcgcgcagcggatggtcgagcagggcgcggcggcaagatcgtcaacatgtcgtcgcaggccgggcgtcgcggcgaggcgctcgtttcgcactactgcgcgaccaaggccgcggtgatcagctacacgcagtcggccgcgctcgcgctcgcgccgcaccggatcaacgtgaacggcatcgcgcccggcgtcgtcgacacgccgatgtgggagcaggtcgatgcgctgttcgcgcgctacgagaaccggccgctcggcgagaagaagcggctcgtgggcgaagccgtgccgctcggccgcatgggcgtgccgggcgacctgacgggcgccgcgctgttcctcgcgtcgtccgacgccgactacgtcaccgcccagacgctgaacgtcgacggcggcaactggatgagctgacgtggcgccgctcgcacgcgtcacctgccggccggcctgcgacggggcggccgcgccgctcaccgcggccgccgtcgaacggggagggcacgcctgatggccgagatcgtcgtcgccggcgaactgctggccgaattcgtcgccgccgagcgcggccagggtttcgacgcgccgggcctgttcgccgggccgttcccgagcggcgcgccggcgatcttcgccgaccaggccgcacggctcggcgcgcgcgtcgcgtatgcgggctgcgtgggccgcgacgcgttcggcgatgcgatcgtcgcgcggctcgagcgcgatggtgtcgacgtcgcgcgcatccgtcgcgtcgcgcgtccgaccggcaccgcgttcgtcgcgtatcgcgacgacggctcgcgcagcttcgtctacagtctgtccaccagtgcggccgcgtgcgtcgatgcgtccgatgtcgataccgcgatgttcgacggctgccgctatttccacgtgatgggctcgtcgctgacgagcgaatcggcgatcgcggccgtgcagcgcggcgtgatcgaggccgcgcgcgccggcgcgaaggtgtcgttcgatccgaacgtgcggcccgagatgctgagctttcgcccgatgcgcgcggcgctcgagacgatgctcgccgcgtgccacctgttcatgccgagcgaggacgatttgccgttcttctgcgggccgcagccggccgagcgtgcgatcgcgggcctgctcgcgacgcatccgctgctcgagcgtgtcgtgctgaaacgcggcgcgcaaggcagcgttgcatttgaccgcgccgaccgcgtcgaagcaccggcctttcgggtcgacgaaatcgacccgaccggcgccggcgactgcttcggcggcacgctcgtggcgagcttcgtcgcgggcgtgccgatcgatgccgcattgcgccgcgcgaacgcggccggcgcgatcgcggtcacgcggcgcggcccgatggaaggcaacagcagcgcggccgagatcgaccgcttcctgaccgaacgaggtatcgcatgtccggcctgacgaccttcgccgaacgcccgcgcaccgcccatgcggacgccgtgctgcggatgatcttcgatgcgaaccgcgcggacgcgcagcgcggcatctattcgatctgcagcgcgcaccggctcgtgctggaggccgcgtgcgaagcggcgcgcgcggatggctcgccgctcctgatcgaggcgacctgcaaccaggtgaaccatctcggcggctatacgggcatgacgcccgccgatttccgccgcgacgtcgacgcgatcgcccggcgttgcgggctggcgccgtcggcgctcgtgctcggcggcgaccatcttgggccgaacccgtggcggcaccgccgcgcggccgatgcgatgcgcgaggcgggcgcgatggtcgccgcctatgtggaagccggcttcgaaaagatccacctcgatgcgagcatggcgtgcgcggacgatccggtgcggctcgacgatcgcacgatcgccgcgcgcgcggccgaactgtgccgcgtggcggaagacgcggcggcgcgcaccggcatcgcgcccgtctacgtgattggcaccgaggtgccgacgccgggcggtgaagtcagcggcaacaacggccgcgacggcgatgcggcgatcgcgcagatcgcggtcacgcgcagcgacagcatcgcggcgacgctcgatgcgcaccgcgccgcgttcgcggcggccgggctcgacgacgcgtgggcgcgcgtcgtcgcgatcgtcgcgcagccgggcgtcgacttcgacgatcgccacgtgctcgactacgacagcgcgaaggccgcggcgctcggcgcgagtatcctgagacaccgcgcctcgtgttcgaggcgcattcgaccgattaccagaccgagggtgcactcgccgcgctcgtgcgggaccacttcgcggtgctgaaggtcggccccgcactcacgttcgcgctgcgcgaggcgctgttcgcgctgaccttcattgaggacgcgctgaccggcgacgtcgggcagcgctcgcggttgcgcgacgtggtcgacgccgcgatgcgcgcgcagcccgagcactgggcgccgtattaccgcggcgacgaaaacgagcagcggctcgcgcgccagttcagctacagcgaccggattcgctactactggctgcagccggccgtcgcggccgcggtcgagcaactgttcgacaacctcgcgcggcagccggtgccggagacgctcgtcgcgcagtggctgccggatgtctacgcggcgtgccgcacgggcgggctcgcgaaggagccgcgcgcgtgggtgcgccaccggatacgcgacgtgatcgcgcactatgcgcgcgcgtgcggaatgcagcggccggcatgacgggccgcgaaggaaacgcaggaccgacgacacttcgaacaaacacaggagacatgccatgcaacgaaagatgctcgacgccgccgcacgctgcttcgccggagccgcgctcgcgacggcggcctgcgccgcgtccgccggcacgctgacgatcgcgacgctgaacaatcccgacatgatcgagctgaagaagctgtcgccggcgttcgagaaggcgaacccggacatcaagctgaactgggtgatcctcgaggaaaacgtgctgcgccagcgcgcgacgaccgacatcacgaccggcagcggccagttcgacgtgatggcgatcggcacctacgagacgccgcagtggggcaagcgcggctggctcgcgccgatcacgggcctgcccgccgactacgacctgaacgacatcgtgaagaccgcgcgcgacagcctgtcgtacaacggccagctgtacgcgctgccgttctacgtcgagagctcgatgacgttctaccgcaaggacctgttcgcggcgaaggggctgaagatgcccgaccagccgacctacgaccagatcgccgagttcgcggacaagctcaccgacaaggcgaaggggacctacgggatctgcctgcgcggcaaggccgggtggggcgagaacatggcgtacgtgtcgacggtcgtgaacacgttcggcgggcgctggttcgacgagaactggaatgcgcagctgacgtcgccggaatggaagaaggcgatcacgttctacgtgaacctgctgaagaaggacggcccgccgggagcgagctcgaacggcttcaacgagaacctgacgctcaccgcatcgggcaagtgcgcgatgtggatcgacgcgacggtcgcggccgggatgctctacaacaagcagcagtcgcaggtggccgacagaatcggtttcgcggccgcgccggtcgccgccacgccgaagggctcgcactggctgtgggcgtgggcgctggcggtgccgaagacgtcgaagcagcaggacgccgcgcgcaagttcatcgcatgggcgacgtcgaagcagtacatcgagatggtcggcaaggacgaaggctgggcgtcggtgccgccgggcacgcgcacgtcgacctaccagcgccccgagtacaaggccgccgcgccgttctcggacttcgtgctgaaggcgatcgagacggccgacccgaacgatccgtcgctgaagaaggtgccgtacacgggcgtgcagtacgtcgggattcctgaattccagtcgttcggcacggtggtcggccagtcgatcgccggtgcggtcgcgggccagatgacggtcgaccaggcgctcgccgccgggcaggccgccgccgaccgcgcggtgcggcaggccggctacaagaagtaacgcgccggcagtcacgcggcccgcggcgtgcgccgttgcgcatgccgcgagccggcgaagccgaaaggcgggcgggccgttcgcgcccgcgcatcaaccggaggaacgccgatcatgcgtcatttacgtcttccctgagccatgctcatgcgccgtcggtcggcgacgcgtcgtcgccgcccggcgcgccgcgccgcgcgcgcggcggcgcgagttggctcgtctcgccgtccgtcgcggtgctgctgctgtggatgtcgattccgctcgcgatgacgatctggtattcgttctcgcgctacaacctgctgaacccggacgtgaaaggtttcgccgggctcgacaactaccgcttcctcgcgaccgatccgtcgttcctgcccgcgatctggcacacgctcgtgctgatcggcgcggtgctcgcgatcacggtggtcggcggcgtgctgatggccgtgctgttcgaccgcaagttctacgggcagggcgtcgcgcgcttgttcgcgatcgcgccgttcttcgtgatgccgacggtgtccgcgctgatctggaagaacatgatcctgcatccggtgtacgggctcgtcgcgaacgcgatgcgcgcgctcgggatgacgccgatcgactggttcgccgactacccgctcaccgcggtgatcatcatcgtcgcgtggcagtggctgccgttcgcgttcctgatcctgttcaccgcgatccagtcgctcgaccaggagcagaaggaagccgcgcgcatcgacggcgcgggcccgatcgcgatgttcttctacatcacgctgccgcacctgaagcgcgcgatcgccgtggtcgtgatgatggagacgatcttcctgctgtcgatcttcgcggagatctacaccacgaccggcggcggccccggcgatgcgacgaccaacctgtcgtacctgatctacgcgctcggcctgcagcagttcgacgtcggcctcgcgtccgcgggcggcatcatcgccgtcgtggtcgcgaacgtcgtgtcgttcttcctggtgcggatgctcgcgcgcaacctgaaggggagtacgaaaaatgagcgacctgaccttcgaaggccggcgcgtgccggccgtgttcgacctcgtgcggcgtgcgctgcccggcacgctcgcgtggctgatcgcgctcctgctgttcttcccgatcttctggatggcgatcaccgcgttcaagaccgagcagcaggcgtatgcgtcgacgctgttcttcatgccgacgctcgacagcttccgcgaggtattcgcgcgcagcaactacttttcgttcgcctggaattcggtgcttatctcggccggcgtcacggtgatctcgctgctgttcgcggtgccggccgcgtacgcgatggcgttcttcccgaaccaccgcacgcagaaggtgctgctgtggatgctgtcgacgaagatgatgccgtcggtcggcgtgctcgtgccgatctacctgctgtggaaaaacgcggggctgctcgataccgtgtcgggcctcgtgatcgtctacacgctgatcaacctgccgatcgcggtgtggatgaccttcacgtacttcaacgagatcccgaaggacatcctcgaagccgggcgcatcgacggcgcgtcgacgtggcaggagatcgtctacctgctgatgccgatggcgctgccggggctcgcctccaccgcgctgctgctcgtgatcctgtcgtggaacgaagcgttctggagcatcaacctgtcgagctcgaacgccgcgccgctcaccgtgttcatcgcgtcgtactcgagccccgaagggctgttctgggcaaagctgtccgcagcttccctgctggcggtcgcgccgatcctgatcgtcggctggctgtcgcagaagcagctcgtgcgcgggctcacgttcggagccgtcaaatgagcgcgaacgtcctgatctgcgattgcgacggtgtactgatcgacagcgaggccgtggcggccgacgtgatcgtgcgcgagctcgacgcgcgctggccgggcgtcgatgcgcggccggccgtgatgccgttgctcgggctgcgcatcgagcgcgtgctggccggcgctggcgacgccgtcgggcgcacgctgtcggccggcgatgtcgacgcgatccgccgcgcggtcgaggcggcggccgtcaacgcgccgatggtcgacggcatcgatgcggcgctggacgcgattcagttgacgacggcctgcgcgagcaacagctaccgcacgtacgtcgaggcggcgctggcgcgcacgggcctcgcgcgcttcttcggcgaccggctgttctgcgcggatgccgtcgcacggccgaagcccgcgccggacgtgtatctcgcggccgcgcgtacgctcggcgtcgtgcctgcgcagtgcctcgtggtcgaggacagcgcgaccggcatcaccgcggccgccgcggccggcatgaccgtgctcggcttcgtcggcggcgggcatgcgtcggccgcgcagatcgacgcgctgcgcgggatcggcgcgcgtcacatattcgacgacatgcacgaactgcccggttacgtcgcgcgctggcaggcgaccggcgcggtgctgccgaactagcaaccacgaacgattgcgcgccgcgttcgacgcggcgcatcacgcatcacgaacgaacggagacagatcatggcaagcgtgctcctgcgcaatatcgcgaagcgctacgacgaaaccgaagtgctgcgcaacgtgaacctcgacatcgccgacggcgaattcgtcgtgttcgtcggcccgagcggctgcggaaaatccacgctgatgcggatgatcgcgggcctcgaggacatctcgagcggcgacctgctgatcgacggcgcgaaggtcaacgacgtgccgagcgcgaagcgcggcatcgcgatggtgttccagtcgtatgcgctgtacccgcacatgacgctgtacgacaacatggcgttcggcctgaagctcgcgggcgcgaagaagcccgagatcgaccaggccgtgaagaacgccgcgaagatcctgcacatcgaccatctgctcgaccgcaagccgaagcagctgtcgggcggccagcggcagcgtgtcgcgatcggccgcgcgatcacgcgcaagccgaaggtgttcctgttcgacgaaccgctgtcgaacctcgacgcagcgctgcgcgtgaagatgcggctggagttcgcgcggctgcacgacgagctgaagacgacgatgatctacgtgacgcacgaccaggtcgaggcgatgacgctcgcggacaagatcgtcgtgctgtcgggcggcgcggtgcagcaggtcggcacgccgaacgagctttaccacgcgccggcgaaccagttcgtcgcgggcttcatcgggtcgccgaagatgaacttcctgacgggcaccgtcgattcggtcgatgccggcggcgtgctcgtgcgcttcgacagcggcgagacgcagcgcgtcgcggtcgaggcggcggggctgcagcgcggcgcggcggtgacggtcggcgtgcggcccgagcacctgaaggtcgaagcggcggccaccggcgtggccgcgcggacgatggccgtggaatcgctcggcgatgccgcgtacctgtatgcggagtcggccgttgcgccggacgggctgatcgcgcggattccgccgctcgacacgtaccgcaccggcgaggcgctccacgtgcacgcgcaggccgagcattgccacctgttcgacgaacacggccaggcgttccgccggctgagcgtgcacgcgaaggccgcatgacggccggccgcggtcacagcggcaggtgcgcggccatgtaatcgacgaacgcgcgcagcttcggcgtcgggtggcggcccgacggccacagcacgtagaccggcgtgcagctcgcgacgtgttcgtcgagcaccgcgcgcagcgtgccgtccgcgagcgcctcgcgcacgaagaagatgggcaggcaggcgatgccgagcccgcgcagcgcgaagcacaggcgcgcttccgcactgttgctgaccatcgcgaccggcacttcgggcggcgtgcccgcgcgcggcacgcgcagcggccaggtttcgagcttgccgctggtcgggaaacggtagtgcaggcagcggtgctgcgcgagatcggccggcgtgcgcggcgtgccgtgccggtcgagatagccggggacgcgacgaggtgctggcggaagtggccgagcagccgcgacgacagccgggaatccgagggctggccggtgcgcagcaccgcgtcgaacccttcgtcgacgacgtcgacgagccggtcgctgaaatcgatgtcgagctcgatttccggatacgcggccatgaaatcggcgagcaccggcagcagcagcgtgccgatcgtcggcaggctcacgcgcaagcgcccgcgtggcgcttcggcactgtgcgtcagttcctgctcggccgcgtcgagctcggcgatcacgcgccggcaccgttcgagaaagcgcgtgccttcggcggtcaacgtgatgctgcgcgtgctgcggtgaaagagccgcaccttcagccgcgcctcgagccgcgcgatgcgtttgccgatcgccgaagccgatagcccgagcgcgcgtccggccgcgacgaaactgcgcgtttccgcgacctgaacgaacacgacgaagccgccgaggttttccatgcgagtttccgattgcggacgccggcgtccggattgtccggaactctaccccggtttttcttcttgcgtcggctccctacgatgagcgctcgttcattgtcgagaggtcacgtcatgtcatccctgcctgtcaccgccttgcgcgtggaaccggacgccgcgttgcgccaccggctcgacgacgcgctggatcgcgcgctcgccgacgcgcgcatggtcggcgcggtcgtgctggtcgcgcaggacggcgagctgcgttatgcgcgcgccgtcggccttgccgatcgggaagccggcacgccgatgcgggacgacgcgctgttccgcctgtcgtcggtcacgaagccggtcgtggcggccgccgcgatgcggctggtcgcggcggggcgcatcgcgctcgacgaaccggttgcccgctcgttgcccggattccgcccgacattggccgacggcacgcctgccgtcatcacgttgcgtcatctgctgtcgcatacggccggcctcggctaccgcttcctcgaagcggacgccgacggcccgtatgcacgcgccggcgtgtccgacggaatggaccgttcgggtctctcgctcgccgagaacctgcggcgcatcgccagcgtgccgctgcagttcgcgccgggtacgtcgtggggctattcgctgtcgatggacgtggtcggcgcgctgatcgaggcggtcgacgggcggccgctcgccgacgcggttgccgcgctcgtcacgacaccgctcgggatgaccgacaccgcgttcgtcgcgcacgacgccgcacgcgtcgcgacgccttacgtgagcacgccgggcgctccgcgccggatggcggacgtcgatctcgtgccggtgttcgacggcacgatcggcatccgcttcgagccggcgcgcgtgttcgatgccgatgcgtggccgtcgggcggcgcggggatggtcggcaccgcacgcgattgcgtgacgctgctcgacgcgctgcgcacgggccgcgacggctggctcgaacccgcatgggtcgacgagatggcgcgtgtccagccgggtgcgcgcgaactgcgggatgcacccggtttcggcttcgggctcgggttctcggtgctgcgcgatccggtggccgcgcagtcgccggagtcggtcggcacctggcgcgggggcggcgcgtacgggcacacgtggttcgtcgaccgcgcggcggggctgacggccgtcgcgctgaccaacacgctgtacgagggcctcgacgggcggatcgtgaccgcggtgcgcgatgcggtctacggcgtcgaaaccgggagcgcggcatgagcgactgcacgacgatcgatgacgagctggccgttcagccggtgcaggccggcgcgcgcctgccggttgcgaacctgctggcgctcgcgacggccgcgttcatcacgattctcaccgaggcgctgccggccggcctgctgccgctgatgagcaccgacctgcgcgtgcccgaggcgctgatcggccagctcgtgaccgtgtatgcgctcggctcgatcgtcgcggcgattccgctcgtcgccgcgacgcgcgcgatgcgccggcgcacgctgctgctcgcggcgctggccggcttcgtcgtgtcgaatgcgctgacagccgtgtcgccgtactacgcgctgacgctcgccgcgcgcttcgtcgcggggatggcggccgggctgctgtgggcgctgctcgccggctacgcgagccggatggtcgatgcctcgttgcgtggccgggcgatcgcggtcgcgatgctcggcgcgccggtcgcgatgtcgatcggcattccggccggcaccgcactcggcgcggcgctcgggtggcgtgtcgcgttcgcgggtatcacgctcgcggcgctcgtgctgatcggctggattcgttggcgtctgcccgattatccggggcagccggccggcgcgcgcgagccggtgctcggcgtgatgacgctgcccggcgtgcggccggtgttgaccgtgatgttcgcgtacgtgctggcgcacaacatgctgatacgtacgtcgcgccgtttctcgcgggcgtgcggatgggcgcgcaggtcgatgcggtgctgctcgtgttcggtatcgcgtcgctggtcggcatcgcgctgacgggcgcgtggatcggcgccgcgcagcggcggctgacgctcgccagcatcgcgttgttcgccatcgcggcggcgatgctcggcgccggttccggcatggcgatcgtctatgcgggtgtcgcgctgtgggggctcgcgttcggcggcgcgccgacgctgttccagacggccaccgcgaacgccgcgggagaggcagcggatgtcgcgcagtcgatgctcgtgacggtgtggaacctcgcgatcgcgggtggcggtatcgcgggcgggatgctgctcggcgcaacgggggcgggtgcgatcccgtgggtgctcgtcgcgctgctggcggccgcgtgggtcggcgcatggcgggctcgccggcatgcgtttccggcgccgcgcgccgcgtgagttggcagtgtgcagatgcgggcgcgatcgctgacggcgcgcgagaaggaggtgttgaaatggactgcggcaggcaagacgtatgccgatatcggattgattctgtccatctatgaccggactgcgaagtttcacctgatgaacgtgatgcgcaagcttcgtgcggccaacaaggcggaggccgtcatgagggccacgatgcccgggtttctgcagtgatgcccggtttgtccgcacgcgtcggcgatccgccgtgcggcgaccgcctgcggtgacgggaagccggcacgccggctacgcttccagcgccgccctcgcgcacgtctcgtcggtgacgagccccgacatccagccgccgcgcaatgcggcgatcaccgcatcgcgtttcttcgggccgcccgcgaacgcgatcgtcgggcgcttcggcggcgtggcgagcgatacgctcgtcacgcgcgtgccggtcgacacatcgatcagcttgccttgcgcgtcgatcggcacgccgagcagttcggccaccgcgccgagcgcggtcatctcgtcgcgctcctgttcggtgatgaagccgtcttcgtagagcgggcagtgcgggccgatgttgccgatcccgacgaacgcgacgtcggcctggcccgacagcgcctcgacgatccggtacagccggtgattgcaccactgcgcgcgctcggcggcgctgtcggcgaacagcggcgcgggcagcaggaagtgcttgctgccggttttctcggagatgtactgcgcgacgtcgtagcggttcgacgaaccgtcggccgcgatcgcgccgaccatcgacacgaggcggtgctgcggtcggtcgatctgcgcgatctgtgcgaccgcggccttcagcgtccggccgctgctgaccgcgatcaccatcggccgcgtttcgttcaggtagcgctccatcacctgcgcgccggcgacggccagcttgcggtcgatcgcgtcgggcgcatcggcatcgacgggcacgacttcgcacatcgcgaggccgtagcgcttcgacaactgcgcgccgagatcgaggcagtcggcgagctggtggtcgacgcgcacgcggatcaggttcttctcgaccgcgaacgcgacgaggcgctgtgcgaccgggcgcgacacctgcagcttttccgcgatctcgttctgcgtgtcgcccgcgacgtagtagagccacgcggcacgcgtggcgagatcgagtttttctgaggacttggacacgatagcgattcggttcggagctgggggccgcccgcggaccggccggcgggccgcatgacggcatccactgtaccgcatgtcgcgcatgcggccgacggccggcgcgcgtgacaggcggcgcttacgcgagccgtgcgcgcgacggttcgtacagcggccgcacgtggcggtacagcgaacgaaacgcatcgaggcgttcgcgcagcagcgcatggcgggcggcatccggcgcgtattcggcccgcaccggcggcttggccagcaccgcatgcggatcgccgccgacggccagccagccgagccgcgccgcgccgagcgccgcacccgtttcgccgccgccgtgctggcgcgtgcgcacgttcagcgcatcggcgatcagttgtgcccagtacgcgctgcgcgcgccgccgccgatcagcgacagctgggcggtttcgacgccggccgcatgcagcgcgtcgagaccgtcggcgaggccgagcgtcacgccttcgagcaccgcgtagccgagatgcgcgcgttcggtcgcatgcgtcatcccgaagaacacgccttgtgcgtacggatcgttgtgcggcgtgcgctcgccggacaggtagggcaggaacagcggggccgtcgcgagcgcgtcggcgtcgagcgcctcgacttcggcgagcagggcgggctcgtcggtgccggtcagcttgcagacccagcgcaggcagctcgcggccgacagcacgacgctcatcaattgccagcgatcgggaatcgcatggcagaacgcatgcacggccgatgcggggttcggcatgaagcgatcgccgaccacgctcagcacgccggacgtgccgagcgacacgaagccgtcgcctgcgtggatcgcaccgatgccaagcgcgctcgttgcgttgtcgccgccgccgccggctaccacgaccgcctccgacagcccgagttcgcgcgcgatgtccgcgcgcagcgtgccggacggcgcattgccttcgacgatgcgcggcatctggtcacgcgtcattccgcacgcggcgagcagtgcgtcggaccagtcgcggcgcgcgacgtcgagccacagcgtgccggctgcgtccgacgggtcggacaccttcgcgccggtgagccggaaccgcaggtagtccttcggcatcagcacgcaggcagtcgccgcgaacacatcgggctcgtgcttcgcgacccacagcagcttcggcgcggtgaagcccggcatcgcgagattgccggccagtgcgtggaggtcgggcgcgcgttcggtgagcagcgcgcactcgtcggcgctgcgcatgtcgttccacaggatcgcggggcgcagcacgcggtcgtcgcggccgagcagcacggcgccgtgcatctggcccgacaggccgatgccgcgcacggccgcgaacgcttgcggatgccgtgcgcgcaatgaggcgagcgcggcgagcgtgccttgccaccagtcgtccggatgctgttcggcccagcgcggatgcggccgcgacacggtgaacggcgagccggcggtgccgacgaccgtgccgtccggggcgagcagcagcaccttcacttccgaagtgccgaggtcgatgccgagatacatgagcgatccgttccgtcagtggggactcgctactttagccgcgcggccgtgcacgtgccaaggcaggttcgccccaatgcgcgtcagcgcgccgcgagccatgcatcgacccgcgcgagcccggcgcgcaacgcctcgaacagcgccgcgttgccggcgagcgaaccccacagcgcggcttgcgcacagcgcggcgacctggtcgtcggccccggatggccgccccggatggccggacccgacgatcgcacgcgcggcgctttcgtccatcacgccgtcctggtacgcatacggcaaggtgccgcgcgcccagcgttcgagaaagcgcaggaacagcgcgggcagcacggctgtggcgaccggcgccgcgccgcgtgcgaacgattcgacgagcgtcggtgcgatgaagccggggatcttcgagaagccgtcggccgcgacgcgctggttcgtgtcgagtacgtacgggttgccgaagcgttcgagcacgacgtcgcggtagcgcgcgagatcgagcgggctcggcgtcaggcacgggatcacgtcctgcgtcacgtagtcgtgcgcgaagcgccggatcgccgcgtcatgcgtgccttcgtggatatacgtgtggcccgcgagcgtgccggcccacgcgatgcagctgtgcgtcgcgttgaggatgcggatcttcgcttcctcgtacgggtgcacgtcgtcgacgagttcggcaccggccagctcccagcgcggccggccggccgcgaagcggtcctcgatcacccactggatgaacgattcgcccatcaccgggcatgcgtcgtcgatgccggtggccgccagcacgcgctcgcgcacgtcggcggtcgggcgcggcgtgatgcggtcgaccatcgcgctcggcgtcgcgacgttcgcatcgaaccacgcgagcaggtcggcctgcccgcgccgctcgaggaattcgcgcatccccgcacgaaagcgcgcaccgttgttgcgcaggttgtcgcagctctgcagcgtgagcgggcccgcgccgcgcttcacgcgttcggcgagcagcgccgcgagcgcgccgtacagcgtcgtgcgcgcaccctgcaggtcggccgcgagatcggcattcgcgacgtcgagccggttgtgttcatcgaggtagtagccgccttcggtgacggtgaacgacacgatccggcaggccggatcggcgccggcgtcgatcagcgcggcgagatcgatcgaccagggcagcacgcgcgtgatcgcgcggatcgtctcgtacgcgcgctcgccttgcggcgtgacggtctcgagcgtgtattcgccgtgctgcgcggcgagcgcgtccatcgtcacgcgcatgtcgtcgcggatgttgccgacggtcagcgaccagcgctcgtcgggcggcacggccgtgttcacgcgatgcagataccacgcctggtgcgcgcggtgaaacgagcccgcgccgatgtgcagcagcacgggcgtgcgggcggagggcgatgcgctcatccggtgtctcctgttcgtgccagattttcctgccgagtacgaatgcgatcatttgctctttgtgtgaacgaatgatcgtattcgggcgaacgaaagtcaaggcggggaaacggcatttcgatggtgcgctgcggcggcgggcggaatgagcgggcggaaaggcgcgcgacacgatcgcgctgtggtgcgcgttcttcatgtgcctgctcgccgtgtatgcggcgttcagctggctgccgacgatgctggccgcgagcgggctgagcgtgtcggtcgcggggacggggcttaccgcgtacaacctcggcggcgtgatgggcgcgctgctgtgcgcgtggacgatcgcgcatgccgggtcgcgctggccgctcgtgctgtgcagcatcggcggcgcggcgagtgcggtgtggctgatggggtcgatgcaagccgccgcacgggctggctgatcgtcgggctcgggctgcacgctgttcgtcaacgcggtgcagtcgacggtgtatgcgctctgtgcgtacatctacccgaccgccgtgcgcgcgacgggtaccggaagtgcgctcgcgttcggccggctcggcgcgatcctcagcgcgttcgcgggcgcgatcgtgatcaccacgggcggcgccacggcctatctgacgatgctggcgatcgcgatgcgcatcgtctgcgtcgcgctgctcgtcgtgcggcggcatatcccgcgactgtcacgtacggcagcgcagccgcgtgaagggaggaactggcccgcacgtcgtcgtgacggcgggcgagtggtgcgttacagcgtggtgcgcacgtgccagagctcggggaacagcacgacgtcgagcatcttgcgcaggtacggtgcaccgctggtgccgcctgtgccctgcttgaagccgatgatgcgttcgacggtcgtcacgtgacggaagcgccactggcggaatgcatcctcgagatcgaccagttcctcggccatctcgtagagctcccagtgctgctgcgggtggcggtacacctcgagccacgcggcttcgaccgtttcgtcgtgctgcgtcggctgcgtccagtcgcgctcgagccgcgcttgcgcgatcgggaaaccgcgccgcgcgagcaggcggacgacctcgtcgtagaacgacggcgcttcgagcgtcgcgcgcacctgttcgaggatgtcgggccggtgcgcatgcggctgcagcatctgcacattcttgttgccgagcaggaattcgagctggcgatactgatacgactggaagcccgacgactgcccgagatacggccgcatcgccgaatactcggacggcgtcatcgtcgacagcacgttccacgcctgcaccagttgctcgaggatccgcgacacgcgcgcgagcatcttgaacgcgggcggcagcgcgtcggtgcgcaccgcgtcgagcgcgccgcgcagctcgaacagcgcgagcttcatccacagctcgctcgtctgatgctggatgatgaacagcatctcgttgtgatcgggcgacagcggatgctgcgcgtcgaggatcgaattcagcgacaggtagtcgccgtagctcatcgacttcgagaaatcgagctgtgcgttgtgccagccggcttcgcccgaggcatcgcccggcacgtgcggcgcttcgtgtgccgcttgtgcggaatgtgctgcgcgtgcgcccgagaacgggcagcccgccggcgcgtcgccgccgggcggctgcatatgaccagaattcacgactatctccagatttgaatgacggggcgcggcgcgcaatccgcgtaaccgcggtgcgcgccgggcaaggccggtcaggtcaccgcgccgcgttcggcgaactcgggcgccttccaggcgtcggtggcgaggatgtcgcgcagcgtctcgacggcatcccacacgtcgacgaagcgcacatagagcggcgtgaagccgaagcgcagcacgtacggctcgcggtagtcgccgatcacgccgcgcgcgatcagcgcctgcatcacctcgtagccgtgcggatgctcgaagctcgcctgcgagccgcgctggtgatgcgcgcgcggcgtgacgagcttcagcgacaggcccgcgcagcgtgcttcgacgagcgcgatgaaggcatcggtcagcgcaagcgatttgcggcggatcgcctgcatgtcggtttgcaggaacacgtcgagcccgcattcgaccatcgacatcgacacgatcggctgcgtgccgcacaggaagcgcgcgatgcccggatcgggcgcgaagcccggctgcatcgcgaacggtgcgcggtggccccaccagccggacagcggctgcgagaagtgtgcgtgatgacgctgcggcacccacacgaatgcgggcgaacccgggccgccgttcaggtacttgtacgtgcagccgaccgcgccgtcggcgcgcgcgccgttcaggtcgaccggcaccgcgccggccgagtgcgcgaggtcccacagcatcagcgcgcccgcgtcgtgcacgaactgcgtgacggccggcatgtcgtgcatgtagccggtgcggtaattcacgtgcgtgatcatcgcgacggccgtgtccgcgccgagcgcggccggcaggtcggccggatcgtcgatcaggcgcagttcatagttgccgccgagctgctcgatcagcccctgcgcgatatacaggtcggtcgggaagttcgagcgctccgacacgatcacgcggcgctcgggcgcgcgctcggcctggtggcgcagcatcgccgacagcagcttgaacaggttgatcgagatggtgtcggtgacgaccgtttcgcccggcgcgccgccgatcagcgtcgcgagcttgtcgccgagacggcgcggcaacgcgaaccagccggccgtgttccagctgcggatcaggccttcgccccattcggcgccgatcacctgctgcgcgcgggcggccgatgcgcgcggctgcgcgccgagcgagttgccgtcgagatagattacgccgtcgggcagggagaactggtcgcgcagcgggcgagcggatcgtcgcggtcgagcgcgagcgcgtcttcacgggtcttgatcatgatttgagtcgtcagtcggggtaatcaggaggcacgcgcgggcagcgcgcgcagcaccgcgcgcacggggctcgcgtcgagcgtcgcgaatttcagcggcagtgcgatcagttcgtagtcgccgggcggcacgtcgtcgagcacgatgccttcgaggatcgccatccggtgcgcgcgcacgcggtgatgcgcatccatcgtcttcgattcctgcgggtcgagcgacggcgtatcgatgccgatcagcttcacgccgtgcgcggcgagcaggtcgacggtctcgggcgcgaccgcgcagaagtcgctgtcccatcgttcgacgctggcgcgtgcatacgtgcgcagcagcacgcgcggcggcacgccgtcgagcgcggccgcgacatcggccggctgcacgaccggcgatgcgccgatgcaatggatcacgcggcacgggccgagataggtgtcgagcggcacggcgccgatcggcgcgccgtcggcgtcgtaatgcagcggcgcgtcgcagtgcgcgcccgtgtgcggcgacagcgtcaggcgtgcgacgttgaccggcgagccggcctccatccgccacacgcgttcgacggaaaccggcgtatcgccgggccacacggggtggcggggctgacaggcggcgagatgtcccagagggtgtccatggcatgacgattcggtgagtcgatgcttcgaatgataggtggacgctcgcagaaagtgcttgcgaaataaacatggacaaaccgccggattggcagataattcgactcagaggaaaacggggaccaaaaatgcacgcgatcacgctcgatgccaccgactgccggattctggcggtactgcaggaagagggcagaatcagcaatctcgacctggcggaacgcatttcgctttcgccatccgcctgcctgcgccgcatgcgcctgctcgaggagcagggtgtgatcgagcactatcgcgcgtgcctgagccgcgagaagctcggcttcgagctcgaggcgttcgtgcaggtatcgatgcgcaacgaagaaaatcaatggcacgagcgcttcgcggaagcgctgcgcgaatggccggaggtggtcggcgcgttcgtcgtgacgggcgagagccactatctgctgcgcgtgctcgcgcacaacctcaagcactactcggatttcgtgctgaaccggctctacaaggcgccgggcgtcatggacatccgttcgaacatcgtgctgcagacgctgaaggacgaagccggcgcgccggtcgggctggcgcgcacgggagcgatcaaagcggtgtaaggccgtggaagccgccgccgtggaacacgagcggcggcgtcgtgtccgatgcggcgcgcacgccgcagcgttcgacctcgccgacgaagatcacgtggtcgccttcgtcatagcggctgcggttgtggcattcgaaccatgcgagcgcgccgtcgagcacgggcatcccggagttgccggccgcatgcgcgattccttcgaagcggtcgcccttgtaggtcgagaagcgcttgcacaggtcgagctgcgaggcagcaagtacgttcaccacatagtggctgttgccgcggaacacgggcgtcgacgccgatttgtgcgcgaggctccacagcacgagcggcggatcgagcgataccgagttgaacgagctggcggtgatgccgatcagctgtccggacggcgcgcgcgtcgtgatcaccgtcacgcccgttgcgaactggccgagcgcttgccggaaagcggccgagtcgaaatccggggattggcctggctcatcgggcagccatccgggacgagacgggcgggcgcggcgcgacgcgagcggggcgggcacggcggacgaaaggcgacaaggcggtcgatggggaaggggtgcgcatggcccgattttagcggaatcggggccgccgggcccggccaggcggcgcatcgagggggcagggtgacgtagcgaacactgcggcgcgcggcaggacgggcaatcgcgcgcggccggcaacgccgttctgtcgcgtttttcgaacggggccgccgcacggtcctgcgcagttgcatctcccaaccgccgatcccggcgccatctatcgcgccgccgccagtccgagcgacagcgcgcccgtcacgatcaggctcgacgcccacaccgcatcgagattgaaccagctccgcgacacgaacttcagcccgagatagcggtacacgagccacgcgagcccgccgccggcgccgatcatcgcgattgcatgcacggccgcgacgacgagcgccatcccgagatgcgcatcgacgagcgtggccgccgcccggtggccggcgtcccggtcgagcccgcagagcccgaggtagatcggcaccagcatcagccccgcgccatgcgcgatcgcgaccgcgaacgaccacagaccgagccgcgccggcggatccgcgcgagcgcacgcggatgccggcgccggatcagcagcacggcgccgaagccgatcacgagcgcgctcgcgccgatccggatcgccgattgccaggcaagcagcgcggcgagcagcccgaacggcagcatcaccgcgaagaccgcgagcgcatggccgagcgcgagatagccgagcgccgcgacgagcgcgccgccgcggcgcgtcatcagcgcgttcgacaccgcgagcggccagcccatcgcggggttgagcccgtggtacaccccgctcgcgagcacggccgcccacagcgcgaactgggcgtgaaggccggtgttcaacgcttgaccgacggatagcagaacgagtcggtcgagcagtcgccgccttcgagccggatctggtgcgcgcgatagccttcggggaactcgacccagtaatcgtcggcgagcgtcagcccgccttccggcccgcatgcgcgagcacctgcgcggccggcacgccatccggataaaactggtcgtcccacgtcgagtagagcgagttggtccagtacacgcgccggccgtcgcggctgatctcgaccatctgcgggccgcccgcgaatgcgcggccgttcgagtgcggcgcacggcgcgcgatgccgccgatgcggaccgatcccgcgagcaccgggttgtgcgggtccgatacgtcgtactggcgcatctcgccggtgccccagcacgacacgtagaggaagcggtcgtcgagcgacaggtcgatgtcggtcacgagcggcggcaccgcgccgaacgatttcagcagcggcggcagttcgtcggccgcggccggctcggccgggatggtcgcggtcttcttcacatggaacttgccgccttcgcgccaccaggtccagatcgagccttcgagattcgtcgtgtcgaccacgacgccgacgaacccgtattcgcgcaccgggtcgtgcgcgggccgcacttcgagcgccatctggtgctgcgcgccgagatcgatcgtctgcacgttgcgccgcgcgcgcaggtcccagaaatgcagccggtgcccgtatttgttcgcgagcaggtcctcgggcacgatgccgttctcgaattgcggcggcagcgcccattcgctcgacaccatgtagtcgcgcggcaggttccaccagaagtcgtagtgcttgtcctgcgggccgcggtcgatctcccagcggccgagcacgtcgaaggtttcgcaatccatgatgaagatgccgggcgcgccgtcggtgccgtccttgccggcaccgcccagcgtgctcacgtagatgccttcgggcccgcagtgaacggtgtgcggccgcgaatagccggttttcgagaagatctcgtcgggctcgatgatcttgtggatgcgcgcctgcgtcggatgcggcttcgtgtcgatcacgtagatgcgcgacgagcgcaggccggggatgatcaggaagcggcgttcgaggaacgcatggccagtcagcggcgacagcgacgacgaacaggcattccagccgaagtggtgaaactcgtcgccggtgttgggcatcgtcaccgtatgcacgatttttccgtaggtcggcgagccgggcttcacgtcgatcacggcgagcgcgtcgggtctggaaaaatcggggctcagcaacaacgtataggcaaactcttccgccggcgcctgcatcgcaagctcgggcgaagcgtgaaacgtcgggtcaggtcgcatgctcatggtgatgccctctcgatgggttcggatcgttgacgcacggccgttcgttgcgggcgtgcgggtcggggttgccgcgcggcgcgcgtggcgccggcaggcgcgatcggcaggcgggtgcacgcgtcggcgacacgtgcggcgcgccgtgcatcagatcgtgaaagcggagaaaggcggtgttccggatcgccgcacgcggggcgagacggacgcacggcaagggaatggcacggtcgaagtggcagcccgcgatgcggcgacggccgggcgagtgatgcgggtgatgtctgttaaggcatgcatatcgatgttccggcagatgatgtttgcatcagggtcgggcacgcatcgggcgctttgcgcgaggcagcgggtttgccgccgtgctcgcgcgtgcctaagtgtagacgagaaagcgggcggccggtcgtgcgcggtacctgtgcaacctgtcaggttcgcgcgcgagtgagatacttgccgcagtgccgttgcgacccgccccgggtgggcagcggcgagacggaacggtggcgccggcgcatgcgtgccggctgccgacatcaacgaaggactgatttcatggtgaacgagatgcttgaaaccgcgacattgggaggcgggtgtttctggtgcacggaggcggtgtttctcgacgtcgacggcgtgacggccgtccagtcgggctacgcgggcggccatacgcgcaatcccggctatcgcgacatctgcgaaggcgacacgggccacgcggaagtcgtcaacgtgacgttcgatccggcgcgcatcggctatcgcgagatcctagagatcttcttcgcgacgcacgatccgacccagttgaaccggcagggcaacgacgtcggcacgcagtaccgatcggtcgtgttcacgcattcggacgcgcaacgcgacacggcgctcgacgtgatccgcgagctggagcgcgagcaggtgttcgggcagccgatcgtcacgcaggtcgtgccgctcgacggcaactactggccggccgaggattatcaccagaactattacgcgcgtaacccggggcagggctactgctcggtcgtgatcgggccgaagctcgcgaaattccggcagaagttctcgcaccggctgaagtcgctgcgcggcgcgtaagcgccggaacggcgggagccggcgcaaacgggcgtcaggccgcctcgttgcgccactgcgcgcacgcggcggcgatctcgcgcgcgagcgcgatgcacgacagcggcgcggagccttccgccttgttgttgatcgtgatgatcaccggctgcccggccagcgcatagcgcgcggccagttcggcgagcgccgagcgcgtggccggatcctcgtcgacgagcttgtcgaacggctcgtatttcgctttcgcctgttcgtacttgaagccgctgtgcaggctccagcgcacgatcagcgggcccggcgcgtcgccgtcgagcagggcgagcgcggccgcctggcgcagcgcgtcgggcatccgtgcgtgcaggccgacgcagtagcgcacaccgagcgcggcgagcgcgcgaatgaaacgcggcgtgagcaggctcgcgtcgcgaatctcgatcgcatagcgggtaccgtcggcgtccggcggcagcggcggcagtgccgcgaagaacgcggcgagccggtcgatcagcgcggccggctgcgcgagcaactggtcgggcagcggcgagaactggaacacgagcacgccggctttccggccgagcccttcgaggcacggctgcacgaactcgcgggtggcgagctgcgcgtcgaggaaggtcgggttcggccccgacggctcgccgcgccggccgcggatgaccgcgtcggtcacggaggccggcgccttcacgacgaaacggaaatcgtcgggcacctgctgcgcgtagcgcaggtaatcggcgaccgacagcgggccgtagaacgaccggtcgaggctcacgctcttcagcagcggatgtgcgccgtacgcttcgagcccttcgcgcgacagcttggtctgcgcgaaatcgccgtcgtagacgatgccgtcccagcccgggaagtaccacgacgacgtgccgagccgaacgttcggcggcaggccggccgccgcgtcggcgacctcggggcgatcggcgcgggcagcacgccgcgtcggcgccggcctttcttcggcggcgcggctggcggggacggttcgtcccacagcaggccggaagcggttggcggtgtttcgtcggaagaacgggagcgggagcgggagcgcggtgccggctgcgcgtcgtcacgggcgtccggtttcacgtgttcgtcggtgcgggcaggcgggccgtcgtcctcgggcgacgcgcgtgcagcgtcggccggcacgccgaacaggtcgaattgcccgtcggcgtgcggcgcgtgcgcgtcgtcgtgctgctgtcgttccggcggccccttgcgccgcgtcctgccgtcacccatgcatgcccagcgtgaagcgccgcctagcgcggcagcgcgtgttcgtacatatagcgccgcgaccacggcagcgttttcgcgctgcgtccggccttgcggcacacgatctggaagatcgacacgtcgtcgtgctcgaacgcatacgcgcagccggcgagatacacgcgccagatgcggaatttttcgtcgtcgacgagttgtcgcgccgcttctgccttcgcttcgaagttttcggtccagatgtcgagcgtgcgcgcatagtgccgtcgcaggctttcgacgtcaatcgcttccaggccgccgcgctgcgcggcttccagcgcgaggctgatgtgcggcagctcgccgtccgggaacacgtagcggtcgatgaactcgccgccgccgagcgcggtttcgccgctttccgcgtcggtcgacgtgatcccgtggttcatcgcgatgccgtcgtcgacgagcaggtcgtgaatccgcgtgaaatagagcggcaggttcttgcgcccgacgtgctcgaacattccgacactcgtgatgcggtcgaactggccgtcgatctcgcggtagtcctgcagccggatctcgatcctgtcctccagcccggccgccttcacgcgcgcggtcgcgaggtcgaactggttctgcgacagcgtgacgccgaggcactgcgcgccgaacttctgcgcggcgcgcagcacgagcgcaccccagccgcagccgatgtcgagcaggcgctggccgggctcgagctggatcttcgtcaggatgtggtcgatcttcttgatctgcgcggtggcgagatcctcgtcgccgttctcgaagtaggcgcacgagtacaccatgttctcgtcgagccacagcttgtagaactcgttcgagacgtcgtagtgatactggatcgccttcttgtcggtgctcttcgtgtgattgaagtagcgcttcacgcgcgcgagcttgctcgcgctcgtcaccgtgctgcgcgcgagcgagtagccgatgttgatgatgtccgacagcttgccttcgatgtcgatcttgcccttcacgtaggcctcgccgagattgtcgaggctcggttcgagcaagagcggcagcgccgacgcgctgttcaccttcagcgtgacctgcggcgcgctgaaggtgccgaaatcgagttggtcgccgttccacagcacgaggcgcgccggtatgttcgctttcgcccgtacttcgtccgcccactgtgccagcttcttttcccagaacatttggattctccgtttgttcgttgaatcgaatacagccaagtatcttgaccggcgcccgccgcttgcgcggcgggcgcccggatgcaacacgagacacgaccggcgtgcgccggcgccgcgcttacggcgacaggcgcgagatcgaccagcctgacgaagcgttggcgtcgcgcgtatagagcagacggtcgtgcagccgcgacgggcggccctgccagaactcgatcgagtcgggcacgaggcggtagccgccccagtggggcgggcgcggcgggttgtcgccgtagcgttcgctgacggccttttcctgcgcttcgagcgtcgcgcggctgtcgatcaccgcgctctgctcggacgcccatgcgccgatgcgcgagccgagcgggcgcgacgcgaaatagcggtcgctttcctcggcgctggttttctcgatccggccttcgatgcgcacctggcgttcgagctcgatccagtagaacagcagcgctgcctgcggatgcgcggcgaggtcgtgccccttgcggctttcgtaattggtgaagaagacgaacccgcgttcgtcgacgcccttgatgagcacgatgcgtgccgacggccggccgtcggcgccgacggtcgcgagcgtcatcgtgttcggctcgggcagcttggcggcgagcgcctccttgaaccagcggtcgaactgggcgaaggggtcgtgggcgacatcggcttcgtcgagcgaagcacgcgaataattgatgcggagatcggcgagagtcgtcatgttatgcaaacgcttcaatctggaaccattgtagccaacgcgcaagaaacgtgcgtgcacagtggcgcgtgcgagcggggagttcaggcaaaatagagggctgcacgacttacgttttccttgctgccatgcccgccgccgacaccgccccgcccagttcttctgatcttaccccgaccccggaaatccagcttgacgtggatcgcgcgcggcgcttcggcggcgtcgcgcggctgtacggcgcgccggccgccgccgcgttcgagcgcgcgcacgtcgcggtgatcgggatcggcggcgtcgggtcgtgggtggccgaagcgctcgcacgcaacgcggtcggcgcgctcacgctgatcgatctcgacaacgtcgcggaaagcaatacgaaccggcagatccacgcgctcgacggcaattacggcaagccgaaggtcgacgcgatggccgagcggatcgcgctgatcgaccccgcgtgccgcgtgaaccggatcgaggatttcgtcgagcccgacaacttcgacgcgctgctcggcggcggtttcgactacgtgatcgacgcgatcgacagcgtgcgcacgaaggtcgcgctgatcgcgtggtgcgtcgcgaagcgtcagccgctcgtcgtggtcggcggcgcgggcggccagctcgacccgacgcgcatccggatcgacgatctcgcgctgacgatccaggatccgctgctgtcgaaggtgcgcgcgcagttgcgcaagcagcacggctttccgcgcgggccgaaggcgcgtttcaaggtcagcgccgtgtattcggacgagccgctgatctatccggaagcggccgcctgcgatctcgaggacggtgcggagccgtccgcggccgcgcacgtcgcggggctcaactgtgcgggattcggttcgagcgtgtgcgtgaccgcgagcttcggcttcgcggccgccgcgcatgcgctgcgcgcgatcgcggcgcaggccgccggctgagcgcgcgacacgcgggcgtgggcgcgatgccgcggcgcgtgatgcgcgccgcgccgcatgcgatgcggggctgttatgcagtcgggctgttacgcagccgggccgttgcggcccggccggtcgtccctcagttgagcgccatgctcagcttgcgccgccacccggcgacgaggtccgggcggtcgccggccagctcgaataccgagatcatcgtgcggcggccgagatcgtcgccgtacgcgcggtcgcgcgtgacgatttccagcaactgctccagcgccccttcatacgcacgccgcgcgatcaggctctgcgcgagatcgaagcgcgcgtcgagatcggccgggttggccgcgatgcgcgcttcgagtgcgtcggtcggcggcaggtcggccgtggcttcgagggcgtcgaaacgagtcttgatcgcctggtagcgcgggtcgccgccttgcacggtctgcggtgacaggcgttccgtctcggcgcgcgcggcgtcgacctggttgctcgcgagcagcagttcgatcaggtcgaggcgtgcgtcgtcgaagccgggattcagcgcgagcgccgcctcgaggtgcgtgagcgcgtcgtcgtggcgctcttcggcgatcgcgtattgcgcggcgcgccgttcggcttcctcggggccggcagcagccggtcgagaaaggcgcgcagctggccttctggcagcacgccgacgaactggtcgaccgggcgcccgtcggcgaacgcgatcacgtgcgggatgctgcgggtctggaagtgcgcggcgagttcctggttctcgtcgacgttgaccttcacgagcttccagcggccttcgtaatcgccttcgagtttttccagcagcgggccgagcgtcttgcacgggccgcaccacggcgcccagaagtcgaccagcacggggcgtccagcgacgcctcgatgacgtctttctcgaatgtggcaagcgtggtgtccatgtcgttctctttcgttcgaatgtcgtcaggatggggcggagcgccccttttcaacgcggcttcgactcgggcagcggaatccactcggtctcgcccggcaccttgcccatttcctggcgcgtccatgcttctttcgcgcgttcgatcgcttcgcggctgctggcgacgaagttccattcgatgaagcgttcgccgtcgatcttgtcgccgccgagcagcatcgcgcgcgcgccgctgccgctcgtcagcgtgactgcggcaccgggcgcgagcacggccatctgctcggcgggcaccggcgtgccgtcgatcgcgagctcgccgtcgaccacgtagaccgcgcgctcctcgtgcgacgcgtcgagttcgaggcggccgccggccgcgaattcggccgcgacatacagcgtgcgcgagaacgtcgtcaccggcgagcgcagcccgaacgcatcgccggcgatcaccgtcagcgacacgccgtcttcgttgcgcttcggcagcgtgtcggccggatggtgctcgaacgaaggctcggtcgtctcgtgcgcgcgcggcagtgcgacccaggtctggatcccgtgcacggtgtggccgttttcgcgctgcgcgtcgggcgtgcgttcggagtggacgatcccgcggccggccgtcatccagttcacgtcgcccggcacgatctcctgcagcgatccgaggctgtcgcggtgcaggatcgcgccgtcgaacaagtaggtgacggtggcgagaccgatatgcgggtgcgggcgcacgtcgagccccgtgccgggcggcagcgtggcgggtcccatgtgatcgaagaagatgaacgggccgacgaggcgtgcggcgagtgcgggcagcgtgcggcgcacctgcaggttgccgatgtcgcgcacgtgcggcttcagcagggctttgatcggggcggtcatggcggatcctgtggggcggcggggagatgccggtcattgtactggccgtccgccgccgattccattcgcgccgcgcgggtatcgggccgggggccgaaacccggtagactgaccggcttcccgggaaaacgccgggccgtcccggtattttctgccccgcaggcagtccctttgggatcgcctcttcgggagcctggcgcgaagcgacagggttcgagaacaccttgcacaacgattcgacaatcgaggagacgccgatgatggccccgaaggacttgctgcttgcgctggtcgtgatcctggcgtggggcgtgaacttcgtcgtgatcaaggtcggcctgcacggcatgccgccgatgctgctgggcgcgctgcgcttcacgctcgcggccgtgcccgcggtgttcttcgtgcgccggccgcagattccgtggcgcctgctggtgctgtacggcgcgacgatccagctcggccagttcgtgttcctgttcaccggcatgtacgtcggcatgcccgccggcctcgcgtcgctcgtactgcagtcgcaggcattcttcacgctcgtgttcgcgatgctgttcctcggcgagcggctgcgcatgcagaacctgctcgggctcgcggtcgccgcgggcgggctcgtcgtgatcgcggcgcaaggcggccgcgcaatgacgctcgcgggcttcctgctgacgatctgttcggccgcgatgtgggcgttcggcaacatcgtcacgaagaaggtcggccgggcgaacctcgtgtcgctcgtcgtgtgggcaagcctcgtgccgcccgtgccgttcttcctgctgtcgctgtggttcgaagggccgcagcggatcgcgaccgcgctcgccgggctggacggggcgtcgatcttcgcggtcgtctatctcgcgttcgtcgcgacgctgctcggctacgggctctggagccgcctgctgtcgcgctatccggccgcgcaggtcgcgcaattctcgctgctggtgccgatcgtcggcctggcttcgtcggcgctgctgctcgacgagcatctgacgcgcgcgcagctgatcggcacggcgctcgtgatgggcgggctcgcggtgaacgtgttcggcgggaaactgatgcgccgcttcgcggcatcgtgacgcgccggcacgcactgcgtgccggcggcggggcgggtggccgagtatggctggatacggtcgtcaggccatccggctcttcgcgagcggcggattcgcggcgaaataacgcttgatgccgcggaagatcgcgtcggccatctggtcgcgatagctgtcgtcgttcagccggctctcctcttccgggttgctgatgaacgcggtctcgacgaggatcgacggaatgtcggggccttcagcaccgcgaacccggcctgttcgaccgagcccttgtgcagcttgttgatgccgccgacttccttcagcacatagttgccgtagcgcagcgagtcgcggatctgcgcggtcgtcgacatgtcgaacagcgcgcggttcacggccgcatccgccgtcttgatgttgatgccgccgatcaggtcggacgaattttccttgttcgccatccagcgcgcagcggcactcgtcgcgccgtgatcggacagcgcgaacaccgacgagccgcgcgcggacggcgtcgtgaacgcgtccgcatggatcgacacgaagagatccgcgcccacgcggcgcgccttctgcacgcgcacgttcagcggcacgaagaagtcggcgtcgcgcgtcatcatcgcgcgcatattcggcgcgccgtcgatcttcgcgcgcagcttcttcgcgatgtcgagcgcgatgtgcttctcatacgtgccgccaccgccgatcgcgcccggatcctcgccgccgtggcccggatcgatcgccaccgtcagcaggcgcacggtgccacccttgccggatttcggtgcggtgaacttgtaggtgtcgccgtcgtcgtcgctgtcgtcgcggcgcgcgatgaccggcggcggcttgacggccggcttcgcgggcgtcgaaggcgtgccggcggcgtgcggcgtgtgcggcgtggccggcgtgttctgcgcgaagcgctggaagaacgcatcgctgttgtcgcccgcggcgggcggcgggtgcccgggccggccagcgtggacggcggctgcatctgctgcgcgcgcgcggtgtcgttgagcgcctgttccttgcgttccgtctgcgcgatcaggtcggacagcggatcgggcgcgacggccggatacaggtcgaacacgagccggtacttgtaggcgccgaccggcggcagcgtgaacacctgcggcttcaccgaacctttcaggtcgaacaccatccgcacgacgtgcggctgatactggccgacgcgcaccgactggatctgcggatcgttcggcgcgatcttcgacacgagatcgcgcagcgcctggtcgagatcgaggccgctcaggtcgacgacgaggcggtcgggaccctgcagcagctgttgggtattctgcagcggctggtcggattcgatcgtgacgcgcgtgtaatcgcgtgcgggccacacgcgcacgccgagcaccgacgacgcgtgcgcgagccgcggcgcgacgagaccgagcaccagcgtcgacgcgcccgcgcgcaggatctggcgacgccgccagttgtgcgtcgcggtggccgccgattcgatcgagcggaacggtttgatcaacatctttcgagacatgcctttcctgaagcgctgtacgcccggacggtgaggacgcggccgtcgccatccacgtcgagcgagaaaaccagatcgggtacgccgagcagcgtgcccgcctgttgtggccattcgacgaggcagatcgcgctggaattgaaatattcgcgaaagcctgcgtcggaccattcggccggatcgttgaaacgatacagatcgaagtgatagacctcgagttccccatcctcgcgttcgagtgcgtacggctcgacgagcgtataggtcgggctgcgcacgcgccccgtgtggccgaggccgcgcaggatggcgcgcacgagggacgtcttgcccgcgccgaggtcgccgaccagctggatctgcagcccgtcgaacgcatgcgcgcgggcgagctcgatgcgcgccgcgtcgagcgcgtgcgcgaagcgggtgccgaaggcctcggtcgccgcttcgtcggcgagtgcgatcacgcgctccgcgagcagagcgggcagcatggcgtcgtgaggcggttggctgggcgtggctggcattctcgtaaaatagtgcgatgaaccgattaccggaactcgccgcatccgacaggccttcgactcgtgccgaaggcgcggcaccgtgcgcgctcgacgatgcggcgttgactgcgctcgccgcgcgcatcagggcgtgggggcgcgaattggtttcggggcgatcggcatcagcgataccgatctctcggatgccgaagcaggcctcgccgcctggctggaagccggataccacggcgaaatggattatatggcgaaacatgggatgaaacgcgcgcgtccggccgaacttgtggccggtacgcgacgcgtgatctccgcgcggctcgcctatctgccgaccgaaacgctcgccgccggcgcgcccggcgatgaggctggcacgcccgcaccgcacgactggcgcgcgcgcgaacgggcccggctcgacgatccgcaggcggccgtcgtgtcgatctatgcgcgcggccgcgactatcacaaggtgctgcgcaaccggctgcagacgctcgccgagcgcatcgagcaggcgatcggcgcgttcggctaccgcgtgttcaccgattcggcgcccgtgctcgaggtcgagcttgcgcagaaggccggcgtcggctggcgcggcaagcacacgctgctgctgcagcgcgatgcgggttcgctgttcttcctcggcgagatctacgtcgacgttccgctgccgaccgacgcgcacacgtcgcccgactccgcgcccgagacgcccggtgcccactgcggcagttgcacgcgctgcatcgacgcatgcccgaccggcgcgatcgtcgagccgtaccgcgtcgacgcgcgccgctgcatctcgtacctgacgatcgaactgaaaggcagcatccccgagccgctgcggccgatgatcggcaatcgcgtgtacggctgcgacgactgccagctcgtgtgcccgtggaacaagttcgcgcaggccgcgcccgtcgccgatttcgacgtgcggcacggcctcgaccgcgcgacgctcgtcgagctgttcgcgtgggatgcggacacgttcgatacgcggatgcagggcagtgcgatccggcgcatcggctacgaaagctggctgcgcaatctcgcggtcgggctcggcaacgcgctgcgcgcgggtgagggccggctcgcgccgcaggcgcgcgatgcgatcgtcgatgcgttgcgcgcgcgggccgacgatccgtcgccggtcgtgcgcgagcatgtcgaatgggcactgcgtgccgtgtgaaggcggcgtaaagtgtcgtcggcgcgcggcgctgccgcgcgcatccatcggtcaggagagggccatgttcaatgcagtcatcgacgcaccgttcggcaaggtcggcatccgcacggatgccgcggtggtgcgcgagatcgtctatctgcccgaatcggtgaagccggtcgatccggatacgccgctcgcgaagcgcgcggtcaagcagatcgaacgttacttcgcgcgcgcgtcggcgcgcttcgacctgccgctcgccgaggtcggcagcgcgttccagcaccgcgtgtgggacgtgatcagcgatatcccgcccggcacggtgctgacctacggccaggtcgcgaagcggatcggcagcgcgccgcgcgcggttggccaggcgtgcggcgcgaactacttcccgctcgtgatcccgtgccatcgcgtcgtcgcggcgggcggcctcggcggtttcgcgaaccacgacgacaacgggtattaccagaaagtgaagcgctggctgctggcgcacgagggcgtgccgtactgatgagtgaatcgctgatttcccgaagccgacggcgatgccgccgcggcgtccccgcgctgctcgcgagccgcgcatcgatcgacgtgttttgcgatgcgctgtggctcgagcacgggctcgcacgcaacacgctcgatgcttaccggcgcgatctggtgctgttttcccaatggctcgccgcgacccacgacacgtcgctcgattcggttgacgaagcgatggtgacgggctacatcgccgcgcgcagcgacggcaaggcgacgtcgtcgaatcggaggctgtccgtgttccggcgctattacggctgggccgtgcgcgagcatcgcgcgagcgccgacccgacgctgcggatctcgtccgcgaaacaggcggcccggtttccgtcgacgttgtcggaggcgcaggtcgaggcgttgctcggcgcgcccgacatcgacacgccgctcggcctacgcgatcgcacgatgctcgagctgatgtatgcgagcggattgcgcgtgagcgaactcgtgacgctgaagaccgtcgaggtcgggctcaacgagggcgtcgtgcgcgtgatgggcaagggctcgaaggagcggctcgtgccgttcggcgaagtcgcgcacggctggatcgagcgttatctgcgcgatgcgcggccggcgctgctcggcgcgcgcgcggccgacgcgctgttcgtgaccgcacgcggcgacgggatgacgcgccagcagttctggaacatcatcaagcgtcacgcgcagcacgcggacgtgcgcgcccacctgtcgccgcacacgctgcggcacgcgttcgcgacgcacttgctgaaccacggcgccgacctgcgcgtcgtgcaattgctgctcggtcacagcgacatctcgaccacgcagatctatacgcacgtcgcgcgcgagcggttgaagacgctgcacgcgcaacaccatccgcgcggttagcgcacgtttcgctgcgcaggctccggtgcgcgtaccggcctgcctgcgtcagaccagctcgcgcagcttgtgcttcagcaccttgcccgtcgatgcggccggcaacacgtcgaggacgcggatatgcgcggggcgcttgtaaggcgcgagccgctccgcgcaccatgcgtgcagcgccgcttcgtcggcggtcgcgccgggcacccgttcgacgaacgcgagcacttcctcgttgccttcgaccgcacggccgatgacggccgcctgcacgacgtcagggtgcgcgttcagcacctgctcgacttcgaccggatagacgttgaagcccgagcggatgatcagctccttgctgcggcccgcgatcgtcaccgcgccgtccgcctcctgccgcgcgagatcgccggtgctcagccagccgtccggcgacacggccgcgcgggtggcgtccgcgttgcggtagtagccgagcatcacgttcggcccgcgtacgcgaatctcgccgacttcgccgggcggcacgtcggtgccgtccggcgcgacgatccgcatctccacaccgggaatcggcacgccgaccgagctgtcggtgcgtggcgcgtcgagcggtgtctgcgtgatcgtcgggctgctctcggtcattccgtagccgttgtgcagcggcacgccatacaggcgctcgacgcgtgccttcaggttcgtgtcgagcggtgagccgcccgaatacgcgaagcgcaggcgcggtgcgtgccatgcgtggccgtgcgtgtgcaggtgttcgagcagcttcgcgtgcatcgcgggcacgccctggaagatcgtgacgccttcgtcggcgagcgcgacgcgcacggcttccggcgagaagcgcggcgcaagccgcagcgtcgcgcccgcgtacaggctgccgaggcagaccgacgcgagcccgtacacgtgcgacacgggcagcaccgtgtagacgacgtcgtcgggcgacacgcggcgcagcgcgctcgatgtcgccgcgatgaacagcaggttgcgatgcgacagcatcacgcctttcggcgtgccggtcgtaccggtcgtgtagatcagcgccgcgcattgcgcggcgccgtcggcggcaaccggttcgcccggcgcgctcgcgtcgacgcgatacgaccacgcgccgatgtcgaccggcagtgcgccggcaggtgtcgcgccgtgccgcgcggcatgcgtgcgtgcgtcgggcgatacgtcggtggtgaacgcgatcagcttcgggcgcgcgtgcgcggcgatcgcgtcgagttcgccggccgacaatcgcgcgttcgacacgagcgcccacgcgtcgaggcgggcgaccgcgaacagcagcacgatctgcgcgacgcagttttcggcgacgatcatcacgcggtcgccgccttgcacgccgaggccggcgagcagcgcggccgccgcatcgacggcttgcgacaggtcgccgtacgacagccggcgtgcgtcctcgatcagcgccggatgcccgggtgcctgggcggcccggcgtgcgggcacgtcggcgatgcggcggggcagcgcggcgagcagtgcatcgatgtcgagcggctcggaggaacggaggggcgaggacatggcgtctccagaaaagggcgggcggcggccgacgaggttggcgaacgatcgtgccatgacggcgcgtgcgccacaatcggccattcgggcaatagcgcttcgcgatgtccgcaatgatgatgggcggaatcgctgcggcgacgcagcaggccgcccggcggaaaacgggccgcgagataccgccggcgcgggtgctagggcccaagggcgcgattgcgcgccagccggtcgttcaccattaaaatgccgccatgagcaaatccagacacgtgtccgaaacccctgccacccagctgttgcgccgccacggcgtcgcgttcggcgagcatccgtacgactacgtcgagcacggcggcaccggcgaatcggcgcgccagctcggcgtcgacgagcacagcgtcgtgaagacgctcgtgatggaagacgagcatgcgaagccgctgatcgtgctgatgcacggcgaccgcacggtatcgacgaagaacctcgcacggcagatcggcgcgaagcgcgtcgaaccgtgcaagcccgaggtcgcgaaccgccattcgggctatctcgtcggcggcacgtcgccgttcggcacgcgcaagacgatgcccgtctacgtcgaggcgacgatcctcgaactgccgacgatctacctgaacggcggccgccgcggctacctcgtcagtcttgcgccggccgtgctcacgtcgttgctcggcgcgcagcccgtgcagtgcgccagtgtcgactgagggtttcaccttcgtggcaggccgcgcccgttcggtagaatgggcgccgtttcggcttgcgggcttgccgcgcagccgtccctttaccgatacgttgaaagaagagtccaccgcatgcagatcctgctcgccgccctcgttgcctacctgatcggttcggtgtcgttcgccgtcgtcgtcagtggcgcgatgggcctggccgacccgcgttcgtacgggtcgaagaatcccggcgcgaccaacgtgctgcgcagcggcaacaagaaggccgcgatcctgacgctcgtcggcgacgcgttcaagggctggattgccgtctggctcgcccgccgcttcggcctgcccgacgtcgcggtcgcatgggtcgcgatcgccgtgttccttggccacctgtatccggtgttcttccgcttccagggcggcaagggcgtcgcgaccgcggctggcgtgctgctcgccgtgcacccggtgctcgggctcgcgaccgcgctcacctggctgatcgtcgcgttcttcttccgctattcgtcgctcgcggcgctggtggcggccgtgttcgcgccggtgttcgacgtgttcctgttcggcacgggccacaacccggtcgcatgggccgtgctcgcgatgagcgtgctgctcgtgtggcgtcaccgcggcaacatttcgaagctgctggcggggcaggagagccggatcggtgacaagaagaaggcggccgcggacggcggcgcacaggacggcggcaaggcctgagaaagcgcggcgcttgccgcacgccgggcgcgccgcgtgtgcggggcccggcaggatgacgtgacggatcgtccggcgatcagtcgcggaagttgttgaagtcgagcggcgtgtcggtcacgtccttgcgcagcatcgcgatcgtgctctgcaggtcgtcgcgcttcgtgcccgacacgcgcaccgcgtcgccctggatgctcgcctgcaccttgatcttgctgtccttcacgagccgcacgattttcttcgcgagatcgccggtcacgcccttcttcacggtgacgatctgcttgaccttgtcgccgccgatcttctcgaccttgccgtagtcgaggaagcgcacgtcgacgttgcgcttggccagcttgccgatcagcacgtccttgacctggccgagcttgaaatcgtcatcggcgaacagcgtcagttcgcgctccttctgctcgacgcgcgcgtcggagcccttgaagtcgaagcgcgtcgaaatttccttgttcgactgctcgatggcgttcttcacttcgatcatgttcgcttcggaaacgacgtcgaacgatggcatggcattcctcccttgagatgcggacgcccggctcgcgcgcgggcactcgctataattgcggattgtttgccattttaccgatgccctccgtttgcccaaggccggccatgcgccgcccgggcggacgtgaccgcgaatgccgatgcctcctgacgattccgccctgtcgctgtttcccgaccatccgctcgccgcgcacaacacgttcggcattgccgcgaccgcgcgccttgccgcgcgcgtcacgcatgcgtcgcaattcgaggcgctccatcgcgacccgcgcgtcgcgaacctgccgcggctcgtgctcggcggcggcagcaacgtcgtgttcacacgcgatttcgacggtatcgtgctgctcgatgaaatcaagggccgccgcgtcgtgcgcgaggacgacgatgcgtggtacgtcgaggccggcggcggcgagaactggcacgcattcgtcgcatggacgctcgagcacgggatgcccggcctggagaacctcgcgctgattccgggtacggtcggcgccgcgccgatccagaacatcggcgcatacggtctcgagatgaaggtgtatttcgactcgctggtcgcggtcgagctggcgaccgggcgcagcgagcgcttcgacgccgcgcgctgcgcgttcggctatcgcgacagtttcttcaagcgggaaggggctggccggttcgcgatcgtgtcggtgacgttccggctgccgaagcaatgggcgccgcggctcggctacgcggacgtcacgcgcgaactcgacgcccgtggcatcgcacccgatgcggccgcgccgcgtgacgtgttcgacgccgtcgtcgcgatccgccgcgcgaagctgcccgatccgctcgtcctcggcaacgcgggcagcttcttcaagaatccggtgatcgatgccgcgcaattcgaggcgctgcgcgcccgcgcgcccgagatcgtgtcgtatccgcagccggatggccaggtcaagctcgcggccggctggctgatcgaccgctgcggctggaaggggcgcgtgctgggcgcggcggccgtgcacgaccgccaggcgctcgtgctcgtcaatcgcggcggcgcgacgggcgccgacgtgctcgcgctggcgcgggcgatccaggccgacgtgcgcgcgcatttcggcgtcgagctcgagcccgaacccgtctgcctgtaaccggggtttcgcgccgcttttcgcgggcccgaacaaaagcgccgatcgatgatcggcgcttttacatgggttgccgggtgccggcgcgtcagtgcttgaggcggccgagcagcaggaactccatcagtgccttctgcacgtgcaggcggttttccgcttcatcccatacgacgctctgcgggccgtcgatcacgccggccgtcacttcctcgccgcggtgcgcgggcaggcagtgcatgaagagggcgtccgggttcgcgtggcccatcatctcctcgtcgacgcaccagtcggcgaatgcctgcttgcgggcctcgttctcggcctcgaagcccatgctcgtccacacgtcggtggtgacgagatcggcgcccttgcacgcttcgttcggatcgtcgaacacctcgtagaacggcgcgctgtcgggcgacacgagcttcatgtcgagcgcgtagccgggcggcgtggacaggcgcagcttgaagccgaggatctgcgcggcttcgatccacgtgtagagcatgttgttcgcgtcgccgacccacgcgacggtcttgccggcgatcgggccgcggtgctcgtagtacgtgaagatgtcggcgagcacctggcacgggtggtattcgttcgtcaggccgttgatcaccggcacgcgggagttgtccgcgaagcgctggatgatctcctgctcgaacgtgcggatcatgatgatgtcgaccatccgcgagatcacctgcgcggaatcctcgacgggttcaccgcgaccgagctgcgtgtcgcgcgtgctcatgaagacggcgtggccgccgagctggaagatcccggcttcgaacgacaggcgcgtgcgcgtcgagttcttctcgaagatcatcgcgagcgtgcggtcgtgcagcgggtgataggtctcgtagttcttgaacttgcgcttcaggatacccgtgcgttcgagcacgtactcgtagtcttccagcgagaaatccttgaactgcaggtagtgacgaatggttttggcggtcatgaagcgaaatgcggcgggttgcacccggcagcaaggccggacggcgccgccgtcgggtgtggataactcaaagcagcataaaggattttctgtgctttgacgagccgggagagaagcggggcgcgatcgccgtgtgctgcgggcagcacaggaggaggggtgtcgggacgacgcgcgatggcgcgctgcggtataatccaaagttttctccagcccggcaggcaagcctcttcgcgctctgccggacacaagccgtgcgctgcacaaatccggtgcagtccgccggcggcgcacgtcgacgtctcgttttcggggcatctgaatgcttgtgccgccgtccgtttcagctttgtgttcgcgtatccaggcgccgttgcctggacatcgccgggccgtcacttgggtaaccacatggctgaaacccctccgaccgaattcttcatccagggcatcacgaaagacgggaaaaagtttcgcccgagcgactggtcggaacgtctggccggtgtgatggcctgcttcgggccggggcgagcgggccgaacgcgcgtctcaagtattcgctctacgtgcgtccgacgatgctcggcgacctcaaatgcgtgatcctcgattcccggctgcgcgacgtcgagccgatggcgttcgatttcgtgctgaatttcgcgaaggacaacaacctcgtcgtcaccgaggcgtgcgaactgccggactacgacgcgaagaagtgatgccggcacgggcgagggcgcatgcggcgcccgccctggcacacgtcgccggcccgcaggatgtgcgccggcgacaggcgacaaaaagcccgcctaggcgggctttttgcgatcgcaggaaacaggagcgcccgcgtgagcgggcgcaccggaattacgctgctgcctgcagacccttgacggccgcggcgaggcggctcttgctgcgagcggccttgttcttgtgaacgatcttcttgtcggcgatcgtgtcgatcgtcttcacggcagccttgaacagctcggcagcctttgcctggtcgccggcttcaacagccttgcgaaccgacttgatcgcggtacggaatttcgagcgcagcgccgagttgtgcgagtttgccttcgcggcctggcgggcgcgcttgcgtgcttgtgcggagttagccatgacggttccttatcctgtcctgtttccagagcttggagcctgacggccaagcgctgcttttcgatccgtcccctgagaacgattgcccaggggcgcataaaaacggtgattttaaccgaggccgggacatgaaaacggcagttgccgtgcatgtacgagcccagaaaccggcaattatagcaacaaaatcaagtgagtggcaagttgaacgtgacaaccgtcgggcggggcaccggcggcgtgcgcgctttcggcatcggccgctggccgggccacgcaacgtccgtataataagcgccccatgaatctattccgagccctgctgacggtcagcggcttcacgctgctgtcgcgcgtgaccggactggcccgcgagacgctgatcgcccgtgcgttcggcgccagtcaatacaccgacgcgttctacgtcgccttccgtatcccgaacctgctgcgccgcctgtccgccgaaggcgcgttctcgcaggcgttcgtgccgatcctcgccgagttcaagaaccagcaggggcacgatgcgacgaaagcgctcgtcgacgcgatgtcgacggtgctggcgtgggcgcttgccgtgctgtcggtcttcgggatcgccggcgcatcgtgggtcgtgttcgcggtcgcgtccggcctgcacaccgacgggcaggcgttcccgctcgcggtcacgatgacgcggatcatgttcccgtacatcgtgttcatctcgttgacgacgctcgcatccggcgtgctgaacacgtacaagagcttctcgctgcccgcgttcgcgccggtgctgctcaacgtcgcgttcatcgccgcggccgtgttcgtcgcgccgcacctgaaggtgccggtgttcgcgcttgcatgggccgtcatcgtcggcggcgtgctgcagttcctcgtgcagctgccgggcctgaagaagatcgacatggtgccgctgatcggcctcaacccgctgcgcgcgctgcgccacccgggcgtgaagcgcgtgctcgcgaagatggtgcccgcgacgttcgcggtgtcggtcgcgcaactatcgctgatcatcaacaccaacatcgcgtcgcggctcgggcagggcgccgtgtcgtggatcaactacgccgaccgcctgatggaattcccgacggcgctgctcggcgtcgcgctcggcacgatcctgctgccgagcctgtcgaaggcgcacgtcgacgccgattcgcacgagtattcggcgctgctcgactggggctgcgcgtcacgttcctgctcgcggcaccgagcgcgctcgcgctgttcttcttcgcgacgccgctcacggcgaccctcttcaactacggcaagttcgatgcgcataccgtcacgatggtcgcgcgcgcgctcgcgacctacgggatcggcctcgtcggcatcatcctgatcaagatcctcgcgccgggcttctatgcgaagcaggacatcaagacgcccgttaaaatcgcgatcggcgtgctgatcgtcacgcagatctcgaactacgtgttcgtgccgctgatcggccacgcgggcctgacgctgagcatcggcgtcggcgcatgcctgaactcgctgctgctgttcctcgggctgcgcaagcgcggcatctaccagccgtcgccgggctggctgcgcttcttcgtgcagctgatcggcgcggcgctcgtgctcgcgggcctgatgcactggctgtcgatcagcttcgactggaccgggatgcgtacgcagccgctcgatcgcatcgcgctgatggccgcgtgcctcgtgctgttcgctgcactatatttcggtatgttgtgggtgatgggcttcaaatacgcttatttcagaaggcgcgccaagtgacgaccgcaatgacccgcgtcctcgactacttcagcacgctcgtggcagacgacgacagcctgcccgtcacggaagcggcgctgtcgctggcgcaggacgcctatcccgacctcgacctgcagggcacgctggccgaactcgacatgctggcggcgcggctgcgccggcggctcgccgacgacacggacctgaagggccgcgtcgccgcgctgaacgacttcttcttccgcgagctcggcttcgcgtgcaatcacaacgattactacgaccccgataacagccacctgaacgccgtgctgaagcggcggcgcgggattccgatctcgctgtcggtgctgtacctggagcttgccgagcagatcggcgtgcctgcgcgcggcgtatcgttccccggccatttcctgctgcgcgtcacgctgccggacggcgacctgatcatcgacccggccaacggccattcgctgtccgaagccgagatggtcgagatgctcgagccgtatgtcgcgcgtgcggccggtgcggtcgacagcgcgttgcgcgcactgctgcagccggcgacgagtcgcgagatcatcgcgcggatgctgcgcaacctgaagacgatctatcttcagacggagcgctggcaacggctgctcgcggtgcagcagcggctcgtgatcctgctgcccgagcatctcgacgaagtccgcgatcgcggtttcgcgtatgcgcggctcgactacctgcgccccgcactcgaggatctcgagcagtatctcggcgagcggccggacgcggacgacgcgaccgtcgtcgaatcgcaagtaaccgagttgcggcagcggatgcagcgcgacggcgaggattgagccgccgccgtgctgcctgccggaaccgtgaatgacaaaacgcccgcgatgcgggcgtttttttgcgtgcttatttcggctgcatccggatcgcgccgtcgaggcggatcacttcgccgttgagcatcggattctcgacgatctggcgcaccagcagcgcgtattcggccggtttgccgagccgcggcgggaacggcaccatcgcgccgagcgcgtcctggacgtcctgcggcatgccgagcagcatcggcgtctcgaacaggccgggcgcgatcgtcatcacgcggatgccgttgcgcgacaggtcgcgcgcgatcggcagcgtcatgcccgcgacgccggctttcgacgccgcgtacgcggcctggccgatctgcccgtcgaatgcggcgaccgacgcggtgctgacgatcacgccgcgctcgccttccgcggtcggcgcggtggcggccatcgcggcggccgcgagccggatcatgttgaacgtgccaatgaggttcacgttgatcgtcttcgcgaacacgtcgagcggatgcgcgccgtccttgccgacggtcttcgcggcgggcgcgatgccggcgcagttcacgaggccgcgcagcgtgcccgcgcgcgtcgctgcgtcgacggccgcctgcgcgtcggtctcgctcgacacgtcgcagtgcacgaagatgccgcccagctcggccgcgagcgcggtgcctgccgtgtcgttcaggtcggcgagcacgaccgtgccgcctgcttgcgcgagcatccgcgccgtgccggcaccgaggccggatgcgccgcccgtgatcagaaatacgttgccgcgaatttccatgactgtctccgtgtcgaccgcccttggcgcttcagcgcttggggcggtcccatgcaaggcggtcgaccgccgttggcgcttcagcacaagttgcgcttccggggcaatgcggttgcctgattcttgccccgtgatcggttgaaatgccggcgcaccggtaacacagacgcccgcacccgggcgattgtacggggctccctcacgcggcggcgataccagaacggtcgtgcgaattccgcccgggcaaaaagccgcccggagcgggcggcttgcgggtgcgcgacgcgctgcttacttcagtgcgtcaaacgcgcgctcgcggatttcctcgacggcgccgaggcccgagatcttgcgatactgcggggccttcaggccgttttcctcgccgcgctgcgcccagtcgccgtagtacgtgatcagcggcttggtctgcgcttcgtacacttcgagacgcttcttgacggtttcttccttgtcgtcgtcgcgctggatcagcggctcgcccgtcacgtcgtcatggccttcgaccttcggcgggttgaacttgacgtggtacgtgcggcccgatgccgggtgcgtgcggcggccgctcatgcgctcgatgatttccgagaacggcacgtcgatctcgagcacgtagtcgatcgcgacgcccgcttccttcatggcgtcagcctgcgcgatcgtgcgcgggaagccgtcgaacagatagccgtttgcgcagtcggcttccttcaggcgctccttgacgaggccgatgatcagcgcatccggaacgagcttgccggcgtccatgtagcccttcgcctcgacgccgagcggcgtgccggccttcacggccgcgcgcagcatgtcgcccgtcgagatttgcgggatgccgaacttttccttgatgaagtttgcctgggtgcccttcccgcgccgggcgcgcccaacaggatcaaacgcatggtgatatctccagtatgtagattcgtgtggcgagacgcgaaaagcgccggcgacggtgtgcgcggcgcttgcctggcgcgcggcggaccggtctgatgcggcgcgtcgggttgggcgacgcgcgactgccggcagggccacgggcggggtcaagcgaggacgcgctggtcgcggacggctcgcacaatcgcctgattatgccacgggttattttggtcccggctgaaaaagggcctgcacgcgtgcgagatcggccggcgtgtcgatgccggcttcgggcgcggactcggtgatcagcaccgcgatgcgctcgccgtgccagagcgcgcgcagctgttcgagctgctcggcctgttcgatcggcgcctgcgcaagcgtcggatacgtgcgcaggaaacgcgcgcgatacgcatagaggccgatgtgccgatagaccgggaaagcaggcgcaggcatggctgcgacgtcgggccagtgcggctggtacgcgtcccggctccatggaatcggcgcgcgcgagaagtacagcgcgacgctctgcgcgtcgagcgcgaccttcacgacgttcgggttgaacacgtcggccgcgtcgtggatcgggtgggcggccgtcgcaatcgcgcacgccggatgcgcggcgaggtgcgacgctacgtcgcgcacgagtacggggtcgatcagcggctcgtcgccctgaacgttgacgacgacggtgtcgtcgctccacccgaacgtcgccgcgacttccgcgagacggtcggtgccggacggatggtcggcgcgcgtcagcaccgcttcgaagccgtgatcgcgcgcggcatcgagcacgctctgcgcgtcggacgcgacgagcacctgctgcgcgcccgcttcacgtgcacgctcggcgacgcgcacgaccatcggcttgccgccgagatcggcgagcggcttgttcgggagccgcgtcgacgcgagccgggcgggaatgacggcgatgaagggttgcgggtgagtcatcggggcgggcggtgaaaagagcggagcgggcggcgcgtctgacgcggctcgcccggagggttcggcgccctggccgcggacgggccgcggttcgggctgggtcgggctggctcgggcggcttagcggccggccgggtcgaccggcgtgccttcgacggtctggcgcgcttcgtcgaccagcatcacggggatgccgtcgcggatcgggtaggcgagcttgtccgcgttgcagatcagctcctgcgcggcacggtcatagtggagcgggcctttgcagatagggcacacaatgatttcaagcaggcgagcgtccacggagtttctccacaacgagggcaatgaggcgagggtcgagcgcggcttcgacggggacgacccacagtcgagcgtcgcgccaggaagcgcccaattttactgcatccttctcggtgatcaggatcgcgtcgacggcgtcgtcgacgaacggattgtcggcgaacgcatagtgatcgggcagcgcgcgcgtcgcgggcgcgagaccggccgcgcgcagcgtcgcgaagaagcgttccggcgcgccgatgccggctgcggcgaggacgcgctcgttcgcgaattgcgacagcgggcggcgcagcgccggctggtcgaggtgccacgcggcgcccggcgtgagcgcgagcgaataggtgtcgggccacggcggcagcgcgccgctgtacggatcgttgacgagcgtcgcgtcgcggtgccgcgacagcggctcgcgcaacggcccggccggcagcaggaagccgttgccgccgagccggtggtcgaacacgacgagttcgaccgtgcgcgcgaggcggtagtgctgcaggccgtcgtcgctgacgatcacgtcgacgtccggatgcgcggcgcgcagcgcctgcgcggccgcgacgcgatccgggcagacccagacgggcgcaccggtgcggcgtgcgatcaggagcggctcgtcgccgcccgcgccggcgcgcgacgcggccgtgacggcggtgggcgccttcacgttcgcgccgtagccgcgcgacacgatgccgggtgtgaagccggccgcccgcaacgcgtcgacgagcgcgatcacggtcggcgtcttgccggtgccgccgacggtcacgttgccgaccacgacgacgggcacgccgacgtcgaccggcttcttccagccctgcgcgtaggcggtgcgccgcagcgccgcgcacaggccgaacacgcacgcgaacggcgtgagtgcccacgcgagcgcgccgcggcgctgccattcgcgcgtcaggcgcgcttcgagccgggcgagcgggccgtcgggcgcgctcatcgggccgggcgcggcaggtcgtgcgccgcggcgtgggacggattcgtcaaggcggattctccgttgggcggcgcatgccgcgggtctgcggaaggcggcactctagcgcgccgcgggcgggcgcggcaagccgaccggctgacgcagcccacggacagcccacggggccggatcgcggcggcttgtggataactctgtgaagaactccccgctcgaatgagtcaaacgcccgccgggtgggcctcgaatcggatgagaatcgtttcgaaagttttaaaatatataaaaatcaatgtgttatcgcaaatcgtctggatttttccgcggttttcaggcgtttcaagccgacgattgccaaaatgtggacaccttccgcgcgtcaccgcgcccgcacccggcgctggacgtcgcgcgcgtgtcggactatcgtgtcgccgccagcattcatccgaccgtccatgccttccgactccccatttgccgtgccgggcgccacccgcggcggcgacgaagtgatacccgtttcggcgctcaatcgcgcgatttcgacgatgctcgagcgctcgtttccgctgctgtggatttcgggcgaagtgtcgaatttcacgcgcgccgcgagcggccactggtatttctcgatcaaggaccagcaggcgcagatgcgctgcgtgatgttccgcggccgcgcgcaatacgcggaattcacgccgcgcgaaggcgaccgcatcgaggtacgcgcggtcgtgacgatgtacgagccgcgcggcgaagtgcagctcaacgtcgaggccgtgcggcgcacgggccaggggcgcctgtacgaggcgttcctgcggctgaaggcgcagctcgagggcgagggctcttcgcccccgagcgcaagcggccgctgccggcccacccgcgcgcgatcggcatcgtcacgtcgctgcaggccgccgcgctgcgcgacgtgctgaccacgctcgcgcgccgcgcgccgcacattccggtgatcgtctatccggcgcccgtgcagggcgcgggctcggcggaaaagctcgtcgcggccgtcgagaccgcgaatgcgcgccgcgaggtcgacgtgctgctggtctgtcgcggcggcggctcgatcgaggatctgtggtcgttcaacgacgaggcgctggcgcgcgcgatcgcggcgagcgaactgccggtcgtgagcggcgtcgggcacgagaccgatttcacgatcgcggacttcgcggccgacctgcgcgcgccgacgcccaccggcgccgccgagctcgcgagcccgcagcgcgcactgctgctgcgcgaggtcggcgagcgccagcgtgcgctcgctcgcggcatggaacgccggctggagcagcgcgcgcagcagcttgactggctcgcgcgccggctggtgagcccggccgagcggctgcagcggcagcgcacgcacgtcgagcagctcgctgtgcggctggcgtcggcggcgtcgcggccggtgcgtgacgcgcgcgcgcggttcgcgctcgcgcagttgcgctggcagcgcgcgcgccccgatccgtcgcaggcgcgccaggcactctcggggctgtcgcagcgtcttgcgctcgcattgcagcgccgtcacgaacgcgacacggctcgcgtgtcagcctgtgcggcaaggctcgaggtgttgagcccgcagcgcacgctcgagcgcggttatgcggcgctgatcgatgcgcagacgggccgcgcggtgcgcacgccgaacgcattgaagccgcagcgccgcctgaccgtgcatctcgccgaaggctcggccgacgtgtcgctcgccgacgtgcagccgcgcctcgccgatacgatctgacgtgagcggcgcacgcgccgcgaccgggaaaacgcgcgggaacggcggttgcgcggtatcggctcgtcctgtggacgatgcgcgaacatcgcttttccgcataccgcggataaatggcccgtgagtttgcggggttattcggtctcgcctacaatcggacgctcggcagcattcaacacaagccccctacatactcaacgaaggaatcgccatggctcatacgctcccgccgctcccgtacgctgaagacgcactcgcgccgaccatctcgctcgagacgatccagtaccactacggcaagcaccatcaggcttatgtgacgaacctgaacaatctgatcccgggcacggaattcgaaaacctgtcgctggaagagatcgtgaagaagtcgtcgggcggcatcttcaacaacgccgcgcaaatctggaaccacacgttcttctggaacagcctgtcgccgaacggcggcggcgcaccgacgggcgcgctgggcgacgcgatcaacgcgaagtggggttcgtacgacgcattcaaggaagcgttcacgaaggccgcggtcggcacgttcggttcgggctgggcatggctcgtgaagaaggctgacggttcgctcgacatcgtgtcgacgagcaacgcagcaactccgctgacgacggccgacaaggcactgctgacgatcgacgtgtgggaacacgcgtactacatcgactaccgcaacgcacgtccgaagttcgtcgaagcgttctggaacatcgtgaactgggacttcgcagcgaagaacttcgcgtaaggtccggcacctgcgcgccgccacggcgcgcggtactagcagaaaagccctcgtttcgagggctttttgtttttgccgcggcggaacgtgctccgcgtgcccggtcaggcgaggaggccgagccccagccgagcgcagcgctcgcgatcacgacggcccacggcggcacgcgccagaacaccagcgcgacgaatgcgacgagtgccgcggccaggtcgcgcggcgccatgatcgtgtcggtccagaccgggtgatagagcgccgcgagcagcagcccgacgacggccgcgttcacgcccgcgagcgcggcctgcatccgcgtgctgcggcgcaggcgctcccagaacggcgcggtgccggccaccagcaggaacgacggcgcgaagatcgacaccagcgcgatcgtgccgccgagccagccggtcggcgcctggcgcagcgacgcgccgaggaaggccgagaacgtgaacagcggccccggcacggcctgcgcgacgccataaccggccaggaacgccgcatcgccgacccagccgggcgcgaccacggccgcctgcagcagcggcagcaccacgtggccgccgccgaacacgagcgcacccgtacggaagaacgcatcgacgacggcaagcgtatcggagcgcagcgcgcgggccgcgaacggcagtacgacgaggagcgcggcgaacagcgcgagccacagcgcgcccgcgcgcggcgacacgtgcagcggcaacggatcgtgggtgccgcgcgccggctgcggcagcagcacgaggccggccaatccggccgcgacgatcacggcaatctgcgcccacgcggccggcgcgagcagcgcgacgctggcggccgcggccatcagcgtgacgcggcgcgcatccgggcacagcgtgcgtgccatgccccacacggcctgcgcgatcacggcgaccgacacgatgcgcagcccgtgcaatgcaccggcttcgatcggcgcgcccgtcgcgtgcacgccgagcgcgaacagcatcatcagcagcgccgacggcagcgtgaagccgagccacgcggcgaacatccccgcgtagcctgcgcgcgcgaggccgatcgccatcccgacctggctgctcgcgggccccggcaggaactggcacagcccgacgagatccgcgtaggtgcgctcggtgagccaggcgcgccgcgtgacgaactcggtgcggaagtagccgagatgcgcgaccgggccgccgaacgacgtgaggccgagccgcaggaatgcgatgaacaccggccacggatggcgggagggagcggaggcggtcgacgtgctcaaggcggggcggatggatgaacggacgagccgccacgatagcgcaacgcggcgacggcggggtggccgcgtgacggcgctgccgcggctcagcgcatgccgtcgggcagcctgctcgcgcgccgcagcgcgtcgacgtcgacgagctcgatttcaccgacgtgcagccgcacgacgccgtcggcctgcagcgccttcagcaactggttggtggtctgccgcgtcagcgacagcatcgccgcgagcttttcctgcgacagccggatgcgggtgcggccggcgctgatcccgccgtagccgtcggcgatcatcagcaggcgggcggcgagccgctgcgcggccggcatcacgctcatcgactcgacggtcaggaagctcaggcgcagcttctgcgccatcagcagcgcgaattgccgccagtattgcggcgtcgcgtcgaggatcgcgagcagcgcggcctgcgggacgtgcagcagcagcgcgtcgtcgagcgcgatcgcgtcgtgcgtgcgcggctggccgtcgaacagcgcgatttcgccgaaccacgtgacgggctcggcgaccgtcagcagcgcctccttgccctgcgggtcgaccgcacctatcgtgagtgaaccggccagtaccgcgtacagcccgcacggcgggtcgccgcgccggaacagcgcatggccggccggcagccggcgcagcgccgcgcgggcgagcaggtccgcgcgcaacgcgggcggcagcgcggcgaaccacgggttcgcttcgatctgcggcaggtacggggcgagcgaagagggcatgggcacgcgatgtcgggtagctgacagaggttctcgggcgtgacgcgcatcatagcgctcaaccaccgaccaggagacgcgatgaagacgctcgaagaccatctttcccaatatgcggcctaccaccgcgacgcgcgtaacatcgcgacgcatctggtcgggatcccgatgatcgtattcgcggtcgaggtgctgctgtcgcggccggcgctcgggatgccggccggggtcgcgctgtcgccggcgctgctgctcgccgtcgcgttcgcggtgttctacctgcggctcgacctgcggttcgggatcgtgatgaccgcgctgttcgcgctgggcctgtgggccgcgcaggcgctcgcgttgctgccgaccgcgcagtggctcgcgatcggcatcggcgcgttcgtcgtcggctggatcgtccagttcgtcgggcactggttcgaagggcgcaagcccgccttcgtcgacgatctggtcggcctgatggtcgggccgctgttcgtcgtcgccgaggtcgcgttcttcgcgggactgcgcggcgaagtgcgccgcgaagtcgagcggcgggccggccccgtgcacggcggcgcgcattcgcatgtctgacgcaccggtctgcgtattcggcgcgggcgccgtcggctgctatctcggcggacggctcacggcggccggcgcgaaggtgacgctcgtcgggcgcgcacggatcggcgatgcgattcgtcggcacgggctgacgctgaccgaccggcgcggctatcgcgcgacgctcgccccggccgatgtcgtgttcacgaccgatccggcggctgcggcggccgcgcggctcgtgctcgtggcggtgaaatcggccgcgacgcgtgaggccgcggcgcagcttgccggcgcgctgaggcccggcacggtcgtgatcagcttccagaacggcctgcacaatgccgacgtgctgcgcgaggcgctgccgcaagcaaccgtgctggccggcatggtgccgttcaacgtgatcgagcgcgaacccggcgcgtttcaccagggctcggctggcgcgcttgcggccgacgcgtctcccgcgctgcagccgtttgccgacgcattcgcgcgcgccgggctgccgctcgcgctgcgtcgcgacatgcgggccgtgcagtgggcgaagctgctgctcaacctgaacaacgcggtcaatgcgctcgcgaacctgccgctgcgcgacgaactcgcgcaacgtgcgtaccggcgctgcgtcgcgctcgcgcagcgcgaagcgctgcactgcctggcgctggccgcgatccggcctgcgcggttgacgccgttgccggccgcgtggatcccggccgtgctcgacttgcccgatttcgcgttccgcgtgctcggcggccggatgctcgcgatcgacccgctcgcgcgttcgtcgatgtccgacgatctcgcggcgcagcgtgcgacggaagtcgagtggatcaacggcgaggtcgtgcggctggccgcgcgcgtcggcgcgcaggcacccgtcaatgcgcgactgtgcgcgctcgtgcatgacgcggaacgtgcggcggcgcgcccggcctggcgcggcgacgcgctgtgggccgagttgaccgcgcaggcggtgcgcgcgggcgacgtgcgggccgcgtaggggctgcgcaagccgacgcgcgggcgtgggggccgcacggcaggtgctgcggccaagatgcggggtgcgtcatacgacgcttatgcggagctgtcaccatggtggatcgcccgactctcgatgcctacgacgcccatgctgcgcaatacgcgcaggactggctcgaccaggccgcgccagacgacatgtacgcgctgctggagcagcatttctcgccggggccgaccgcggacgtcggctgcggagccgggcgcgatacggcctggctcgcgtcgcgcggcttcgacgtgcgcggctacgacgcgagcgtcgcactgctcgacgaggcgcggcgccgccatccggacctcaccttcgagctggccgcactgccggcgctggccggcgtgccgtccggcgcgtttcgcaacgtgctgtgcgaaacggtcgtgatgcatctcgaacaggcggacgcggccgccgccgcgcggctggccgagctcctgatgccgggcggcacgttgtacatgagctggcgggtggccggcaacggcgcgttgcgcgacgagcgcggccgcctttacacgccgctcgattcggcgcggatgcgggcggcgctcggcgcgggcacgcaggtgatcgacgagcacgaggtcgtcagcgcatcgtccggcaagcgcgtgcaccggctgatcgcgcgcaaggccgccgccgcgtgagcgcagcgcggcggcgcgctcattcgcggttgagtgccgcttcccagttgatgtcgacgcacagcacctgcatgccggtcgcgaccggcgcggcgatcgacgcggtcacgcacaggtgcgcctcgttgatcgacaggtaggggacgtcaggtgcacgtggcccggcgcgcgcatcgcgtcgatgaaatacgggcgccgttcccagctcgcgccttccgagtgcagcagcggccggaagcgcttggcgcgctgcgatacgctgccgcgcgcgagcacgttgtcgccgatctggcgccccgatgcgtcgagcaggaaacaccgggcggtctcgggcagcccgagtacgacggccgccgcgtcggtgagcggctcgcccgcgccgagcttccggctcgcttcctcgagcgccgcgacgtacggtgcgagccgttccgcctgcgtgcgctcgcgttgcgcgacgcgcagccgcaatgcggccgacagcgtatccatgcagcccgcggcggcctgcggctgcaccggttcgacgctcggccccgcgaaatactggccctgcacgaaatcgacgtcgcactcgagtgcgatcagcgcgtcgcgctcggtcgcgagcccgcccatcagcacgagctggccggattcgtgcagcagcgacacgagccccggcagcacgcgttcgagatgcgagtgctcgcttgcctgcgcgaggatgccgcgatcgagcgtgacgatgtcgggatgcaggtgccacacgcggtcgatgttcgaatgcttcgcgccgaacccgaccagcgcgatcaggaagccggccttgcgcagcccgtcgacgatcgccgcatagcgcggcgtttcgccgcccgcctgctcgggcacttcgagcaccacgcgatgcggcggcagcccgagcgccttcaggttcgcgagcagggcgtcgctgtagacggtgtccatcagcgcggccggatgcaggctcaggaagagccattcgtcatgactgtcgaacgcgtggaagttgccgagatgcagcgattcggcgagccggccgagctcgagcaggtcgccgcgccgcgccgcctgcgtgaacacctcgtgcgacgccacctggcggctgtcctcgtcgtgcgcacgcagcgacgcgtgatagccgatcgcgcggcggtgcgacaccgagaaaacgggctggaacacgctgaacacggtgtagccgccgtacagcacggtgcgccggttcccgtcgtcgccggcgacggggcggggcggctgaaagccggggatcgatttcgatcatgctcatgatgtcggccgaaggaagactgccagtttacctagagaataggcgagcaagaagcgtgcacggcatcgtacccgtgcggcggcgcgtcgcggccgggccgtcggtcatcgccggcgcatcgaacggcccgcgctgcaccgcaatggtgcgcgcagacccggttcggcgcgcgccgcgcgtcacgcgcgctcggacggatcggtcttgcgcgcggtgctgcggatctcgggcgcgagctgcgcgaagatccacgcggaagcggccgtgatgatcccgacgcagatgaacgtcgcatggaacgccggcagcgtgttgctcggcgtcacggtgcgcagcatgcccgtgaacgtcgcgagcagcgcccccgcgaccgtgacgccgaggctcatcgacagcatctgcacgagcgagaacaggctgttgccgctgctcgcgccgcccgtgccgagatccttgagcgtcagcgtgttcatcgcggtgaactgcatcgagttgaagccgccgaacagcgcgagatgcacgaccttcacccagaccggcaccgtgtcacgcatcagcgcgaagctcgccatcatcacgccgaccatgatcgtgttcacgagcagcaccttgcgatagccgtagcgcgtgatcaggcgcgtgatgatccgcttcgagaacatcccggccgccgccaccggcagcatcatcagcccggcctcgaacgccgagtagccgaggctcacctgcagcagcagcgggatcaggtacggcatcgcgccgctgccgatccgcgcgaacaggttgccgagcagcccgacgctgaacgtgtggatcctgaacagctcgagcgagaagatcggctgcggcgcgcgcaccgcgtacaggccgtatgcgacgaagcacgcaaggctcaggatcagcagcacgagcacggccgcgtgctgcatgccgagatcggcgaggccgtcgagcgacagcgagatcgcgaccatgccgatcgtcagcagcagatagcccttcaggtcgaagcggccgacggccgggttgcgcgaatcgggcatcgaatagaaggtcgcgatgcagcccgcgacgccgaccggcacgttgatcaggaagatccagtgccacgacgcgatcttcaccagccagccgccgagcgtcggcccgatcagcgggccgatcaggccgggaatcgcgacgaacgacagcgcggacaggtagcgttcggccgggaacgtgcgcagcaccgcgagccgcccgaccggcagcagcatcgcgccgccgacccctgtacgacgcggaacgcgacgagttgctgcagcgtatgcgcgttcgcgcacagcagcgagccgagcgagaacaccaggatcgcgctgaagaacacgcgccgcgtgccgaaggtatcggcgagccagcccgacacggggatcatcaccgccatcgtcagcgagtacgcgatcacgaccgactgcatgcgcagcggcgattcgccgaggctcgcggccatcgacggcagcgccgtgttgacgatcgtcgagtcgagcgtctgcatgaagaagcccgttgcgacgagccagagcatcaaggtgaggttcttttcgccgggagcggcggcaggcgggcgctggaacatgggggcggggcggtggtgcgggacagccgacattgtagggaaagccgtcgcgccgtgcaggttcggcgcaagggcggtgcgaagtccggccggcgggtgcctgtcctcgtcgagcgaccggtacagttcagccgaaagggtctgccgccgtatctgtccgtgtgctgccgctgtccgaaatactggtgccatcgaacccgtgcgaccaggaggctgccatgcgcgaactgcgactttacgtgatcgaaggcgacgagccggccggtcggtggcggatcgtcgatcgcaccgcactggaggtggccgacggcgaggtctgggtgacgatcgagggccggatcgacgatcactggctcggcgccggcgattcgctgacgctcacgcccggcatgcgcgtctgggtcagcgcgggggcgcacggcgcgacgttcgcgttcggtccgctcgacgcgcccgccgtgcgcgccgcgcaggcgtggtggcggccgctcgtcgcatggcgcgacggccggcgtcatgcgccggcatcgttgccgacgtagcctcccggcgctggcggaccggcttgcgtccaggattgctcgcgacggtcgcgaattctagactcgatcctgtctccccaaggctcgtcccgccatgacacctgaactcgcgttgacgcatctgtggcggctcgcacacggcgaccccgacgcgccggcacgcgcgaccgtgacggggcaggacccgacgctgccgtcgaccttccgggtcggcacgctggccgcggcgacgatcgcggcagccgggctcgcggcggccgaatgccatcggcttcgcacgggcgttgcgcaaaccgtcgacgtatcggtgcgcgacgcgctcgtcgcgttccgcagcgaacgctatctgcgcgtggacgacggcccgccgccggagttgcgtcatccggtgacgggcttctacgagacgcgcgacgggcgctggatccagttgcacgcaaactttccgcatcacctgcagggatgctcggcgtgctcggctgcggcgcgcagcgggacgacgtcgccgcggcgatccgcacgcgggacggcgcagcactcgacaccgcgctggccgaggccgggctgtgtgcggcattgatcagaacgcctgacgagtgggcggtgcacgagcaggcgcgtgcgatcgcctcgctgccgctgttcgagatcgagcggatcggcgatgcccccgtcgagccgatcggcgggggcgacgccggccagccgcttgccggtgtgcgcgtgctcgatctcacgcggatcatcgcggggccggtcgcgggccgcacgctggcgtcgcacggcgcgcagacactgctcgtcaacggcccgcacctgccgaacatcgcgccgctcgtgatcgacaacgggcgtggcaagcgttcgacgtggatcgacctgcgcgacgacgcgggcgtcgatacgctgcacgcgctcgcacgcgatgcggatgtgttcctgcagtcgtaccggcccggcgcgctcgcggcgcgcggcttcgaccgctcgcgctggcggcgcggcggcctggcatcgtgtgcgtgtcgatatccgcgtacgggcatgcggggccgtgggcgcagcggcgcggcttcgacagcctcgtgcagtcggcgagcgggatcgcgtggcaggaacagcaggccgcgcacgcgaacgcgccgcgccacctgccgtgccaggcgctcgatcatgcaacgggttatctcgcggcgttcggcgcgatgatcgcgctcgcgcgccgggcacgcgaagggaagctggcacgtgcgactgtcgctcgcgcagacgggccactggctgcagtcgttcggtatcgtgccggacggcctgcaggcacccgatttcgcgcgcgctgacgtacgcgaccggatcgagcgcatcgcgtcgccgttcggcatgctcgacgcggtgcggcccgccgagcggttatcggtgacaccgccgtcgcttgcgcgcccgtccgtgccgcccggcaccgacgatgcgcgctggctgtaagcgccggcggcgcggccggcgttacttgcgcagttcgacgacgaagtcgtagtagtcgttgcggcagtaggtatcggtcagttcgatcgcgcgctggtccgacgtatagccgattcgtgtgatcagcagcagcgcgtcgtgtggtgcgatgcccatctgctcggcgatctcgtcggtcgcgttgaccgcgcggaaatgctgcagcgcgcgcacgatcggcgtgccgcgcgcttcgagatagctgtacagcgaatcgccgattgcctgcggatcggggatcagcgtcgcgggaaacgtcgaattctcgacggccatcacgatgccgtcggcgaggcgcaggcgtttcaggcgcgtgaccgatgcggccggcgacagcccgagctggatcacttcgtcgcggttcgccggctggatctcgcgtgcgagccattgcgagctcggcttgaagccgcgccgttcgagcatttcgctgaagctcgacagccgcgacagcggatcctcgtagcgcggctggatgaaattgccggcaccctgcgtgcggcgaatcaggccttgctcgacgagcagcgcgatcgccttgcgcgcggtgatgcgcgatacgcccagtgcatcggacagcacgcgctcggagggcaatgcctcaccggctgtccagcggttgtcgtggatcgcgtcgccgagcttgcgggcgagctgcaggtagagcggcgtgtcgttgtcggggtcggggcgcaggtcctgccagcggtcgtccgtggatgccttcatggagtgggtatcgatcaggttgcggccattctaagtcatcgcgtggcgccgttatagccggtttttgccgtgcaataggtgaattgcgcgccgattgactacactgatgcgtcgtattccatgcctgggtcgcggtgcgcggccacgaatccgcaacgaggaacgcatgacagacacgatcgccacggtcgtcctgccggacggcgagacgattccgaagcttggcctgggcacgtgggagatgggcgagcggcccgcccggcgcgcggacgagatcgccgcgctgcgcgaaggcgtcgcgctcggaatgacgctggtcgacacggccgagatgtacggcgacggcgcgaccgaggaactggtcggcgaggcgctcgcgggcctgcgcgacgacgtgttcctcgtcagcaaggtctatccgcaccatgcgagccggcgcggcgtcgttgccgcgtgcgatgcgagcctcaagcgcctgcgtaccgatcgcctcgacctgtatctgctgcactggcgcggctcggtgtcgctcgatgaaacggtcgaaggcttcgaagcgctgcagcgcgcgggcaagatccgtcactggggtgtcagcaacttcgatacggccgacatggccgagctcgtcgatgaagccggcggcggcgcgtgcgcgaccaaccagatcctctacaacatcgcgcggcgcggcggaattcgacctgctgccatggcttgccgggcacgggatgccggcgatggcctacagcccggtcgatcacggacggctgccgaagcgctcgccgctcgacgagatcgcacggcagcgcggggtgtcggtgatgcgcgtcgcgctcgcgtgggtgctcgcgcagccggggtttcgcgatcccgaaggcgtcgcgcatcgaacacgtgcgcgacaaccgggccgcgctcgatttcatgttcagcgatgacgagcgcgcgcagcttgacgcgtacttccgtccgccacgcagcaagcgcgcgctcgagatgctctgacgacgcccggccgggcaacgcggcaggtcagtggttgcctccggaggatccgccgttgccgtgaccgccgccattgccgttcccgctgccatggccattgccgacaccgttggccccgccattgccggcgccgccgctgccgtttccattgccgttgccaccgccattgccgtggccaccgttgccaccgtcgccatggccaccgccatcaccgctgccatggccaccccgttgccgtgaccgccgccatcgccgctgccatggccaccgccgttgccgtgaccaccgccatcgccgctgccgtggccgccgctgctgccgtgaccgccgccatcgccgttgccatggccaccaccattgccgtgaccaccaccatcgccgttgccgtggccaccgccgttaccgtgaccgccgccatcgccgttgccatggccgccaccattgccgtgaccaccaccatcgccgttgccgtggccaccgccatcgccattgccgtgaccaccaccatcgccgttgccgtggccaccgccgttaccgtgaccaccaccatcgccgttaccgtgaccgccgccgtcaccgctgccatggccaccgccgttgccgtggccgcccccatcgccgtgaccaccgccgtcgccattgccgtgaccaccgccatcgccatggccgccaccattgccgtgaccgccgccgccggaagaaccgccgccggaagagccaccaccggaagagccaccgccggaagagccaccgccggaagacccaccgccggaagagccaccgccggaagacccaccgccggaagacccaccgccggaagagccaccgccggaagacccaccgccggaagacccaccgccggaagagccaccaccggaagagccaccaccggaagagccaccgccggaagacccaccaccggaagacccaccaccggaagacccaccaccggaagaaccaccaccggaagaaccaccaccggaagaaccgccgccggaagacccaccgccggaggaaccccaccggaagaccctcccgaaccaccgttaccagacgcgttgccaccgcggcccgagccacccgaaccgctcgtgccgccggatgttccgctcgtcgttccgccgacgccggcaggtccgacggtaccgttcccgttgttgccgttgccgctgccgccgccgccgccattgccatttccgctaccggggctgctgccgctgccattgccggtcgcacctgcgccattcccgccggcgcgcccaccggcgaagacgtgcaccgagcacgcagccggattcgctgcgcacggcgaagcgtcgtcgaccagcatcatgacggcgtccgcgccggcaacggcatcgggcgcggagtccggtgtcgcgtcctgtgcgacggcatacgagcagcagcacgcgaacgcggctgcggcgaacaaggttgcgcgatggcaccgtcccgtcgtgcggaacggtcgtttcgtcttgagcatcatggcctccccatgcgcgcgatgcctcgtcgccgcgcggcaatctacgtgtagtgcagggggccggtaaaggttcgtagtcctgtcggcagccgatcgccttcgggccggcgctggacgccagcctcgatcgcggagcggcatgcgggcccgccgtgcgaagccctatctgccagatccgtgccatcggccgcttgagcccgcggctcaaggcgcgcgcagcgcgcgacggcgcatgcaacgtctttggtaggagttttgtttccggaatgaaacgtctgagctaagttcagcgcgcgggcgcatcggccgcgcgctgccagcggtggaacaggatcgatgcgatccagcagacgaggaacagggcgacgatgccgtagccgatcgagccgaagcgctcgccgaccgcatcgagcgcgtcgcgcacggggcccgtcagcgacagcttgtcggccagcaggccggctgcctcgatcccgccgatcgccagcgcgacggccgccgacacgaacgtgatgctcgcgttgtagagcagcttgcgctgcggatcgtccatcgcccagccgtacgcgtgaatcatcagcacgttatcggtcgagtcgatcagcgtcatgccggcggtgaaaagcgcgggaaacagcatgaccgtatagaccggcagcccctggctcgcctgtgcggccgcgatcgcgagcaggccgatttcggttgcagtatcgaaaccgagcccgaacagcacgccgaccggatacatgtgccagctcttcgacacgaaccggaacagcggacgcagcagccgggatacgagcccggccgggcggtgcacatgcgccgcatcgtgcgcgtgcccatgcccgtgcgtgccgcgatagcgccgccacacgtcgcgcaggatcgccaggttcacgcacgcgagcacgagcaggaaggtggccgacaccgccgtgccgattgtgccgccgatctcgcggaacgcatcgaaccggtcccgcagcgcgaatgccgtcagcgcgatgccgagcgtcgcggcgatcacgatcgtcgaatggccgagcgagaagaacagcccgacgctcaccggacgctggccgtcctgcatcagcttgcgcgtggcaacgtcgatcgcggcgatgtgatcggcgtcgaccgcgtgacgcagcccgagcccgtaagcgatcgccgcggtgccgagcagcagcggatgatcgcgcaacacggcgagcgcccacagccagacggcggcgttcgcggcgatcaggccggcatagaggatcagcaggcggcgcagggcaggggtgggcggcatcgggacgttccatctgacgattcgcgctgcattgtggcacgcgaaaaataccggtcgtgccgatcaaagccgcgtgcacggcgtgcacgaatgaaaaaggcccgtccggttccggacgggccttgctgtgcgacagcgcgagatcgcgccgcgcttacttcactttcgcgctgatcacgccttccgatacgttggccggcgtttccgcgtactgcttgaactccatcgtgtaggttgcgcggccctgcgtggccgaacgcagcgacgtcgaatagccgaacatctccgcgagcggcacctcggcgcgcacgagcttgccgccgccgcccgcgatgtcttccatccctgcacgatgccgcgacggctcgacaggtcgcccatcacgttgcccatgaactcctcgggcgtctcgacctcgacggccatcatcggctcgagcagcaccggcttcgcacggcgcatcgcttccttgaacgccatcgagccggccatccggaacgcgttttcgttcgagtcgacgtcgtggtacgagccgaacgtcaggtgcaccttcacgtcgacgaccgggtagcccgcgagcacgccgctcttcagcgtttcggtgatgcccttgtcgacggccgggatgaattcacgcggaatcacgccgcccttgatctcgtcgaggaactcgtagcccttgccggggttcggctcgagcgtgatcaccgcatggccgtactgaccgcggccacccgactgcttgacgaacttgccctcgacgtcggacgccgtcgtgcgcaccgtctcgcgatacgcgacctgcggcttgccgaccgtcgcttcgacgccgaattcacgcttcattcggtcgaccaggatttcgaggtgaagctcgcccatccccgaaatgatcgtctggccggactcttcgtcggtctgcacgcggaacgacggatcttcctgcgcgagacggttcagcgcgaggcccatcttttcctggtcggccttcgtcttcggctcgacggcctgcgagatcaccggttccgggaattccatcttctcgaggatgatcggcttcgccggatcgcacagcgtgtcgccggtggtcgcttccttcaggccgacggccgccgcgatgtcgcccgcgcgcacttccttgatttccttgcgctcgttcgcgtgcatctgcaggatccggccgagccgttccttcttgtccttggtcgcgttcagcaccgtgtcgcccgattcgacgacgcccgaatacacacggaagaagatcaactggccgacgaacgggtcggtcatgatcttgaacgcaagcgacgagaacggctcgtcgtcgctcggatgacgttccgccggcttttccggatcgtggaagtcgtggccgaggatcgcgggcacgtcgacgggcgacggcaggtagtcgatcaccgcgtcgagcatcgcctgcacgcccttgttcttgaacgcgctgccgcacagcatcggcacgatctcgttcgcgatcgtgcgtttgcgcagcgcggccttgatctcgtcctcggtcagcgattcatggtcgtgcaggtacttctcgagcagttcctcgctcgcttcggccgcggcctcgaccatcttctcgcgccattcgtgcgcgagctcgacgaggttcgcggggatgtcctcgtatgtgaacttcacgccctggctttcgtcgtcccacacgatcgccttcatcttcacgaggtcgacgacgccctggaaatgatcctccgcgccgatcggaatctggatcggcacggcgacgcctttcaggcgctcgccgatctgccgctgcacgcggaagaaatcggcgccgatgcggtccatcttgttgacgaacgcgatgcgcggcaccttgtacttgttggcctggcgccagacggtttcggactgcggctgcacgccgccgaccgagtcgtagaccatgcacgcgccgtcgagcacgcgcatcgagcgctcgacttcaatcgtgaagtcgacgtgcccgggcgtgtcgatgatgttgatccggtgctccggatagttgccggccatgcccttccagaaggccgtggtcgcggccgacgtgatcgtgatgccgcgttcctgctcctgctccatccagtccatcgtggccgcgccgtcgtgcacttcaccgatcttgtggctcacgccggtgtaaaacaggatgcgctcggtcgtcgtggtcttgccggcatcgatgtgagcactgatcccgatattgcgatagcgctcgatgggggttttgcggggcacgtgaacctccttaggttcggatcgtaagcgggccggctgggccggcccgggctggactagcgagatttaaaggatagcgcttgtccgtggcttttgcagatgcgggcagtgttggccgaatcaaggcgggcgccgccgccggcaggcgaaaaagccggcgcgcaacgggcggccggcttgggtcggtacgcggcgcggcgtgacgtgacgcgggtcgggtcggcggcgcggcgatatccgttactgggcttgcggcagcccttcgagcttcatcccgggcttgatgcccttcgccgcgaaccagcccttgctcatttcgagggcatagacgccgttgttgcgcgggcagtggttgtcggtcgtctcggccttcatctcgtcgatgtcggtgatcgtgccgtccgcgcggatgaacgcgatcgacagcgggatcagcgtgttcttcatccagaagcagtgcaccgcgttctcgttgaacacgaacagcatgccttcgttcggcgcgagctgcgaacggtacatcagcccctgttcgcggtcggggtcgttcgcggcgacggccgcgtcgatcacgtacatgccggcgcgcagcttcacgcgcgggaattcgctcggctgcttggcgccgggcggcacttgcgcgctggcggcctgcatgccgagcgcgaggacggcgagcgcggcgggaaacacggcggcgcgcgcaaggcggccgagcgacgagcgcagggagaattgcacagcaaggctcctatctggaaaacaagacccgcatggtacgcgatgcgcgccgacgggcacataaagaaaaaggcagatcgccttgcggtgatctgcctttcaacgccgtaagaacggcaagactgcgtgttcttgactgcgttattacagcaagcttacttagttcgaagcagctgccggtgctgctgcatcgcttgttgcagccttcttcgatgccttgtggtgcttcttagctgcgtggtgcttcttagcagcgtgcttagccggtgccgaagcagcttcagcagcagccggagcagcttccggagccgatgcttgtgcgaaagcagccgttgcgaagaggccagcgaccagagcggcgatcagtttgttcatgttgtgttcctcagctttagttaattaaccaaatgacccggcaataggagtcatgtcgtctaacggtgccatccacctttcggttgacagacgcttcgagaaatttctcattgcgctgcgggcgccgaatcgtattcgataaaaacgtcgctttcgtgacgcaaacacggctcggctgccaatgccggatagctaaggttggcatctgcgtggtttaacgcgcgatcttcgcgggcggttgacgaaaaagatgacgaaaaattcgcccgtcccgaattcgtcatccggcgggcgcgaaaccgtcccacggcgcgcgcggcggcagcgcgattgtttctcccggtgcaatgtcgagcgcgaatatatccagtgcaccgatgccgacgcgtaccaggcgcaacgtcgggaagccgacggccgccgtcatccgccgcacctgccggttcttgccttcggtgatcgcgagttcgatccacgtcgtcggaatcgcggcgcggtagcggatcggcgggttgcgcggccatagcgcgtcgggcggttcgatgaattcggcgcggcatggccgcgtcacgtagtcgccgaggtcgacgccgcgcgcgagcgccttcaggtcggcggcgcccggcgcgccctcgacctgtgcccagtagcgcttcacgagcttgtggcggggctcggcgatgcgcgcctgcagcgcgccatcgtcggtgagcagcagcaacccctcgctgtccgcgtcgagccggccggccgcgtagacgccgggcgttttacccagtcgccgagcgacgggcgcgtctcgtgcgcggaaaactggcaaatcgtgccgaacggcttgttgagggcgatcaggttcatggcgggtcgtccgcccggcgcgccgcgggaggcgggggcaggcggtctatggcaaatggcggaatcttaatgcataatacggaacgccaagtcctctgtcttatataagacataagtggggtcttgatacgcagtgccgcgcttcatgccgaagtgcccggttggggcgctagaatagcggctcgctgttgccgtcacggggtggccatgccgcgccccgccgcgcgcgcagcttcgaccagcatcacctgctcagccacgtcactggagtcgatcatgccgtatcagcacatcaaggttccggaaggcggtgacaagatcaccgtcaacaaggacttctcgctcaacgtttccgatcagccgatcattccctatatcgaaggcgacggtacgggcttcgatatcacgccggtcatgatcaaggttgtcgacgcggcggtcgcgcatgcctacaagggcaagcgcaagatccactggatggagatcttcgcgggcgagaaggcgacgaaggtgtacggcccggacgtgtggctcccggacgaaacgctgcaggtgctcaaggaatacgtggtgtcgatcaaggggccgctcacgaccccggtcggcggcggcatccgttcgctgaacgtcgcgctgcgccaggaactcgacctgtacgtgtgtctgcgcccggtgcagtacttcaagggcgtgccgtcgccggtgcgcgagccgcaaaagatcgacatggtgatcttccgcgagaactcggaagacatctacgcgggcatcgaatgggccgcgggctccgagcaggcgaagaaggtcatcaagttcctgcaggacgagatgggcgtgaagaagatccgcttcccggaaacctcggggatcggcgtcaagcccgtgtcgaccgaaggcaccgagcgtctcgtgcgcaaggcgatccagtacgcgatcgacaacgatcgcaagtcggtcacgctggtgcacaagggcaacatcatgaagttcacggaaggcctgttccgtgacgccggttacgcgctggcgcagaaggaattcggcggcgagctgatcgacggcggcccgtggatgcgcgtgaagaacccgaagacgggcaacgagatcgtcatcaaggattcgatcgccgatgcgttcctgcagcagatcctgctgcgcccggccgaatacgacgtgatcgccacgctgaacctgaacggcgactacatctccgacgcactggccgcgcaggtcggcggcatcgggatcgcgccgggcgcgaacctgtcggattcggtcgcgatgttcgaggcgacgcacggcacggcaccgaagtacgcgggcaaggattacgtgaacccgggttccgagatcctgtcggcggaaatgatgctgcgccacctcggctggacggaagcagccgacacgatcatcgccgcgatggagaagtcgatcctgcagaagcgtgtcacgtacgacttcgcgcgcctgatggaaggtgcgacgcaggtgtcgtgctcgggcttcggtgaagtgctgatcgagaacatgtaagtccccttccggggtgggccggcaggtgccggccgccccggcgctgactgccggcgccggagcgtttcgtggatggcaggtttgttggcagggcggtccggcaagcgggccgcggcgccgcgatgcggcccggaggccctgcaaggtagaacatgacggccctcgcaacaccaccgcccggctgagccggcgcgcccctttcgcgaccgacccggtcgctccccgccggttaccgccggcgctcctcagtccaaattttcacgtagcaacgcatcgaccatgtccacttcgcccaagatcatctataccctcactgacgaagcgcccgcgctcgcgacctattcgctgctgccgatcgtcaaggccttcacgcgttcgtccggcgtcgccgtcgaaacgcgcgacatctcgctcgccggccgcatcgtcgcggcattcgcagacgtcctgccgcccgagcagaagggttccgacgatctggccgaactgggccagctcacgctgaagccggaagcgaacatcatcaagctgccgaacatcagcgcatcggtgccgcagctcaaggccgcgatcgccgaactgcaggcgcagggctacacgctgccggcctatccggaagatccgtcgacggacgaagagaaggccgtcaaggcccgctacgacaagatcaagggcagcgcggtgaacccggtgctgcgcgaaggcaactccgaccgccgcgcgccgctgtcggtcaagaactacgcacgcaagcatccgcacaagatgggcgcgtggaaagccacgtcgaaggcgcacgtcgcgcacatgagcgaaggcgacttctacggcagcgagaagtcggcgctgatcgccgaagccggcagcgtgaagatcgaactcacgacgaccgacggcgcgaagaaggtgctgaaggaaaagacggccgtgaaggcgggtgaagtcatcgacgcatcggtgatgagccgcaacgcgctgcgcagcttcatcgaagcgcagatcgccgacgcgaaggcgcaggacgtgctgttctcggtgcacctgaaggcgaccatgatgaaggtctcggacccgatcctgttcggtcacttcgtgtcggtgttctaccgcgacgcgcttgcgaaacacgcggacgtgctggcgcaggccggcttcaaccccaacaacgggatcggcgacctgtacgcgcgcctgaaggacctgccggccgacacgcgcgaagcgatcgaagccgacatcaaggccgaatacgcggtgcgtccgcgccttgcgatggtcaactcggacaagggcatcacgaacctgcacgtgccgagcgacgtgatcgtcgacgcatcgatgccggcgatgatccgcgattcgggcggcatgtggggcccggacggccagctgtacgacgcgaaggccgtgattccggatcgttgctacgccggtgtctaccaggccgtgatcgaggactgcaagcagcacggcgcattcgatccggtcacgatgggcagcgtgccgaacgtgggcctgatggcgcaggcggctgaagaatacggttcgcacgacaagacgttcctgatcccggcggatggcgtcgtgcgcgtcaccgacgaagcgggcaacgtgctgctcgagcatgcggtggagtcgggcgacatctggcgcatgtgccagacgaaggacgcaccggtgcaggactgggtcaagctcgcggtcaaccgcgcgcgcgcgaccggcgcaccggccgtgttctggctcgatccggcacgcgcacacgacgcgcagatcatcgcgaaggtcgagcgttacctgaaggaccacgacacgaacggcctcgacatccgcgtgatgacgccggtcgacgcgacgcgcttttcgctcgagcgcatccgtgcgggcaaggacacgatctcggttaccggcaacgtgctgcgcgactacctgaccgacctgttcccgatcatggaactcggcaccagcgcgaagatgctgtcgatcgtgccgctgatggccggcggcgggatgttcgaaacgggtgcgggcggctccgcgccgaagcacgtgcagcagttcgtcgaggaaggtttcctgcgctgggattcgctcggcgaattcctcgcgctcgcggcatcgctcgaacacctcggcaacgcgtaccagaacccgaaggcgctcgtgctcgcgaagacgcttgaccaggcgaccggcaagttcctggacgagaacaagtcgccggcgcgcaaggtcggcggcctcgacaaccgcggcagccacttctacctgtgcctgtactgggcgcaggcgctggccgagcagaccgaggacgcggcgctgaaggcgcagttcgaaggcgtggcgaagtcgttgtccgacaacgaagcgcgcattctggaagagctggctgccgcgcagggcaaggcgcaggccatcggcggctactatcgtccgaacgtcgacctgacgagccaggcgatgcgcccgagcgcgacgctgaacgccatcgtcgacgcggttgcctgacgcgggccgcgcgatcgcgcgagttgaagcaagtgacggcggggcgggcctggctgccctccgcccgtcacaagaaaaacgcccggtcgcccggggcgtttttgttgcaggcttgccattcagacgtgaacgatttcccattcggcgatttcgtgcggcacttcgagcgttgccgtgtccagttcggacagttgctcgcagtcgccgcgggagatgtggtcggccgccacttcggggcacgagaatgcgccgagcagggcgttgccgaacgtcgcttcccagccaccgttacccggcaggatgtagaacgacccgagcgctgaaccaaagcgaaatcccttcatttccgttctccctttctgatcacaagcgattctgttgtgccgtctgccggttcgaccggctgtggcccgactggctgcttgcgccgcgttccttatcgaacgtcgtggcgaagcgtcagtgcatgggacaaagtctacgtccgcgacccggttggatggtgcatgtcgaacggctccactaaacaaaaattctctttcaaaaacaaatatttgcattcggcgttttgtattgcggaacgtttttcggcatcgcgaaacgggaaatttgtgccctgcaccacgaatttttacaacgcagagagttgttccgcatcgtgaaatattggcgggtttgcgaaccggcgacgcggccggtgctggggcgtggctgaacggcaggcgccgggcggccgcctggagactgcatggggcgggcggcgagtggtgttggggagcgagtgaagggctgcggatcgccgatcgacgatgccggtcgatgcgtgctgaatccagcgcggcgttgtcgagtctgcggcgtatcgccgcccgtccggcggcgacgcgtctcgatatgagcctgcggttatgatgacgcgggcatcaggattggcgtcgcgcatcggcgcttcagccggccggcgcgggcgtcgcggcggccgcgcgacgcagcatggataacgaggaacgatttgatgatacggagaaccttcctgtcgcgcgccatcggtgtcgcggccgcgtcgctgttcgcccgcgccgcgtgggcgcagcatgccggtcacgccggcatggccggcatggactcgatggacgacatgcccggcatgtcggacatgtcaggaatggcgggtcacgggcagcacggcaagtccgccccggccgcgctcgctgccgccgacgcgctgccggccggcgcgccgctcgcggcgctgcgtacgctcgcgaacgaaagccgcgatcccggcacgttccgggccacgctggtggcccagccggtggcgcgcccgatgctgcgcggtgcgcggccgaccacgttctggcagttcggctcgggcacgcagggcccagtcgttggtccgctgatcgacgtgcgcgagggcgacacggtcgagatcaagttcgtgaacaagctgccgcaaccgtcgacgatccactggcacggcctgccggtgccgcccgaccaggacggcaacccgtccgatcccgtcgcgcccggcgcgtcgcgagtgtaccgcttcacgctgccgaaggggagcgccggtacctactggtaccacccgcacccgcacatgatgacggccgagcaggtgtttcgcgggctcgccggcccgttcgtcgtgcgcgccgcggacgatccgctggcgggctggcccgagcgcaacctgttcgtgtcggacctgaagcttgcgcgcgacggcacgattgcaccgaacgacatgatggactggatgaacggccgcgaaggccagttcgtgctggtcaacggcgcgcgccggccgcggatcgacgttgcgggcgacgagcgctggcgcgtgtggaatgcgtgcagcgcgcgctacttgcgggtcgcgttcgacgacggccgtgcattcgagcatgcgggcaccgacggcgggctgtacgacgcgccgcgccgtgtcacgtcgctgctgatcgcgccgggcgaacgtgcggaactgctggtgcgcgccggcgatcgcgcgtcgcgcgcggtgctgcaggcggccgaatatgaccgccgcaagatgtcgatgtcgcacgatgacgggcacggcagcctgccggccgatccggcactggcgctggccgacgtcgcgttttcgccggccaccgcgcgcgtgctgccgacgacattgcgcgcggtgccgccgttgggcgagccggttgcgcacaaggaggtcgcgttcggcgaggagatggatatggacgcgatgatgaagggggcgcgcacggccgcccggcgggcatgcgcttcacgatcaacggcgacacctacgcgccgcaccgtgcaacactgacgagccgcgctggcgacgtcgagcgctggacgatccgcaacggcactgacatggatcacccgttccacctgcacggcacgcagttccaggtgatcgaacgggcatcgggcggttcacgcacgagcgaaccattccgtgcatggcgcgataccgtgaacgtgcgcagcggcgaaaccgtgacgattctcgtcacgcaggacatgcgcggagagcgcatgtttcattgccacattctcgaacacgaggatctcggcatgatgggtacgctgaaggtcgtgtaacgaagtgacgattatgtttcacgtgccggatgagtatccgatctgcgtgtgtgacaagacaatacgtgttcaattatcgggattgaacgaaagaccggccaatcgataatcgattggccggcctcgaaaagaaacccggcgcaatgcgccgggtttcttcgtctgatatccggtgccttatacggcctggatgttcgacgcttgcttgcccttcggcccttggacgacgtcaaagctcaccttctggccttccttcagcgtcttgaagccattcatggtgatagccgagaagtgcgcaaacagatcctcaccgccctcatcgggagtgatgaaaccgaagcccttcgcgtcgttgaaccacttaacgataccagttgccatttcctacttccctgtcacacagtcgctgctacttaccacgagcacgctcgaaaagctaaacgaccggaaaatgcagccgttccccctcacaagctcacctcggcctctttcaacttgccgaccggcaaattgaaaaagtgccagcttgattgttggcgctctttattggagtgtcaagtggaatttttagacgtttagagggacgttgtaaagaacccattttcagggtttttccggctttgcttggcagcacgcggccaagcgcgaggacttgaaaagccgcataatcggctcatataccaggctcgagtgacacgcgttcgagtcgtcccggcttgtgggatactggatgcggacacgacgttccggtgcggttcccctgacggttcgtgttccgcgccacgcgtgaaagccggcaccgcagccggctttcgtatggcacgaagaagattgcgtgttccgggattccggggagggcgccggccggtcggtcgggtaatggcaggattgcgggcctgtccgagttgtttagaatgggtgtatggcgattatcccggacaagcaggacagcaccgtcctggaacgcaagcagcagaagctcaagccgccttcgatgtacaaggtggtgctgctgaacgacgacttcacgccgatggaattcgtcgtgatggtggtccaggagtatttcaagaaggatcgcgagacggccacgcagatcatgctgaaggtccatcgcgaagggcgaggggtttgtggggtctatacgcgggacatcgcgtcgaccaaggttgagcaagtcgttacccatgcgcggcaggccgggcatccgctgcagtgcgtgatggaggaagcatgattgcccaggaattggaagtcagcctgcacatggcgttcatggaagcacgccaggcgcgccatgagttcataacggtcgagcatttgctgctggccctgctggataatccgacggcagccgaggtgttgcgcgcgtgcgcggccaacatcgaggacttgcgtcagaacctgcgcaatttcatccacgacaacacacctaccgtcccgggtaccgacgatgtcgatacccagccgacgctcggtttccagcgcgtgatccagcgcgcgatcatgcacgtccagtcgacgtcgaacggcaagaaggaagtcaccggtgctaacgtgctggtcgcgatcttcggcgagaaggattcgcatgccgtctactacctgcaacagcagggcgtcacgcgcctggacgtcgtcaacttcatttcgcacggcatcgcgaagaccaacggcggcgaagccgccaagtcggccgacgcgagcgcggaaagcgaagacgcgaacgcgcagaaggaaacgccgctcgcgcaattcacgcagaacctgaaccagatggcgaaggacggccgcatcgatccgctgatcggtcgcgagcccgaagtcgagcgcgtggtccaggtgctgtgccgtcgccgcaagaacaatccgctgctcgtcggcgaggccggcgtcggcaagaccgcgatcgcggaagggctcgcctatcgcatcacgcgcggcgaagtgccggacattctcgcgaatgcgcaggtctactcgctcgacatgggcgcgctgctcgccggcaccaagtaccgtggcgatttcgagcaacgtctgaagacggtgctgaaggagctgaaggagcgtccgcacgcgatcctgttcatcgacgaaattcatacgctgatcggcgcgggcgccgcgtcgggcggcacgctcgacgcgtcgaacctgctgaagccggcgctgtcgtcgggcacgctcaagtgcatcggcgccaccacgttcaccgaatatcgcggcatcttcgagaaggatgcggcgctgtcgcggcgcttccagaaggtcgacgtgagcgagccgaccgtcgagcagacggtcgcgatcctgcgcgggctgaagtcgcgcttcgaggagcatcacggcgtcaagtattcgtcgggcgcactgtcggccgcggccgaactgtcggcgcgcttcattaccgaccgtcacctgccggacaaggcgatcgacgtgatcgacgaggcaggcgccgcccagcgcatcctgccgaagtcgaagcagaagaagacgatcggcaagagcgagatcgaggaaatcatctcgaagatcgcgcgcgtgccgccgcagagcgtgtcgcaggacgatcgcagcaagctgcagacgctcgaccgcgacctgaagagcgtcgtgttcggccaggatccggcgatcgatgcgcttgcggcctcgatcaagatggcacgcgcgggcctcggcaagatggacaagccgatcggcgcgttcctgttctccggcccgacgggtgtcggcaagaccgaagtggcgcgccagctcgcgttcacgctcggcatcgagctgatccgcttcgacatgtcggaatacatggagcgtcacgcggtgagccgcctgatcggcgcgccgccgggctacgtcgggttcgaccagggcggcctgctgaccgaggccgtcacgaagaagccgcactgcgtgctgctgctcgacgaaatcgagaaggcgcatccggacatcttcaacgtgctgctgcaggtcatggaccacggcacgctgacggacaacaacggccgcaaggcggatttccgcaacgtcatcatcatcatgacgacgaacgcgggcgccgagtcgatgcagaaggcgacgatcggcttcacgacgcgccgcgagacgggcgacgagatgaccgacatcaagcgcctgttcacgccggagttccgcaaccgcctggattcgatcatcagcttccgctcgctcgatgaggaaatcatcatgcgcgtggtcgacaagttcctgatccagctcgaggaacagctgcacgagaggaaggtcgacgcgctcttcaccgacgcgttgcgcaagcatctcgcgaagcacggcttcgacccgctgatgggcgcgcggccgatgcagcggctgatccaggacacgatccggcgcgcgctggccgacgagctgctgttcggcaagctcgtcaacggcggccacgtgacggtcgatgtcgacgaaaacgacaaggtgcagttgtcgttcgacaagctggcgaatccgccgcacaagccgaacgaagagacggtcgaagtcgagtaagcgataattcgttgttcatgcgaacggcgcgggaagttctccgcgccgtttcgttttatccggcgccggcggcgtggtggtgcagggagtggtaaggcagtgacacaacaacaacggtcgttcgacaacatcgtcgcgcgcgaacaagggttgcgccatgcgctgacgtcggggcagatggcgatgatcgcgatcggcggcgcgatcggcacgggcctgttcctcggcagcgggttcgcgatcgggctcgccggcccgagcgtgctggtctcgtatgcgatcggcgcgctgatcgcgctgctgctgatgggcgcgctcgcggaaatgacggtcgcgcatccgaccgccggctcgttcggcgcgtatgccgagcactacgtcggccccctcgccggcttcctggtgcgctatgcgtactggttcgcggtggtgttcgcgatcggtaccgagatcagcgcgatcgccgtgttcatgaagtactggttcccggccgtgcccggctggtactgggtgatcggcttctccgcgctgctgatcgccgtgaatctcgcgagcgtcacgctgtacggcacggtcgaatacgcattctcgctgctgaagatcgcggcgatcgtcgtgttcatcgtgctcggcgcgtatctcgtgtggtcggcgccggtcgcatccggcatcggtttcgccaactacaccgcgcacggcggctttatgccgaaggggccgtggggcacctgggtcgcggtgatcgtcgcgatcttcagctacatgagcatcgaagccgtcgcgatcgcggccggcgaggcacgcgatccgcagcacgcggtcacgcgcgcattccgctcgaccgtgttccggctcgtcctgttctacctgctgacgctgtcgctgatgctcgcgatcgtgccgtggacgcaggccggcaccgacgaaagcccgttcgtgaaggtgatggccgcgacccacgtgccgtacgcggcgggcgtgatcaacttcgtgttgctgatcgcggcgttgtcggcgatgaacagccagctttacgtgacgacgcggatgatgttcagcctgtcgcgcgcgcggctcgcgcccgcggtgttcggccggctcggcacgaacggcgtgccgcgcgcggcgctgtggatctcgaccagcggcgtcgcggtcgcggccgtgctggtcgcgctcgcgcccgacaccgcgttcacggtgatgatggcgatcgcgatgttcggcgcgctgttcacgtggctgatgatcttcgtcacgcacctgcgcttccgttcgcggtatcgcggccccgcgctcgcgttccggatgtgggggcatccgatcggcagcctgctcggtgcggggctcgtcgcggcgatcctgttcacgaccgcgttcacgcgcgaattccggatgacaatggtggtcggcgtcgtgttcgtcgtgctgctcacgctcgcgtacgcgctgcattaccggcacgaacacgctcgttgacggcgccggcgcggccgcccgcgccgtttttccggtcgctaaggttcggttaagcccgcggcgactacattcgatcctgcctgcaaggcgggcgcggcatgcgccggctcgccgccttcctgcaaaaagggtgcgaatgaacaaacttcccgaaatcacggtcgcgttctggatcatgaagatctgcgcgacgacgctcggcgaaaccggcggcgacctgttgtcgatgacgctgaacgtcggctatgcggcgagctcgatcctgctgttcggtttctttctcgtgacgctgggtgcgcagctcaggacgacgtgttatcgcccggcgatctactgggccgtgatcgtcgcgacgagcacggccggcacgacgatgtccgatttcatggatcgcacgctcggcctcggctatgcggccggctcgtcgatcctagtcgcgatcctgctgaccatcttcgccgtgtggcgcctcagcggcgaatcgctgtcggtcgacctgatccgcacgcgcaaggtcgagctgctgtactggatcgcgatcctgttctcgaacacgctgggcaccgcgctcggcgacttcctcgcggacagctcggggctcggtttcggcggcggcgcgctgctgatcggcgggttgctcgcggcgatcgtgcttgcgcactatttcacgcggatctcgggcgtgctgctgttctgggccgcgttcgtgctcacgcggccgttcggtgcgacggtcggcgatttgctgacgaagccggttgcgaagggtggcctcgcgctcgggacggttggttcgtcggcggtgctgctcggcgtgctggtcgcactggtgatctacgcgatcgtcgcccaggcgcggcagcgcgaccttgcgcccgcgcggatcgcgcaacccgtcgaagagtgacggcgacggacaggaaaaagggccgcgaggcctttgtcattgcgccgttcagtgacgcccggtgctgccgaagccgccctcgccgcgatcgctttccgcgaagtcgtcgacgatgttgaactgcgcctgcacgaccggcacgatcacgagctgggcgagccgttcgaacggattcagcacgaactcggtctggccgcggttccacgtcgagaccatcaactggccctggtagtcggaatcgatcaggccgacgaggttgccgagcacgatgccgtgcttgtggccgaggcccgagcgcggcaggatcagcgcggcgtagcccggatcggcgaggtggatcgcgaggcccgtcggcacgagcgtcgtttcgcccggctgcagcgtcaccggcgcgtcgaggcacgcacgcaggtcgaggcccgcgctgccggtggtcgcgtaggcgggcaggtagtcgcgcatgcgcgcgtcgagaatcttcaggtcgagtttcatgcggtcgtcggatgaggcgggaagggcgcggcggcggccgccgcgcgggagatcagatcaggcggttgtcgggcaggcgtttcgcgatttccgcgacgagcgtgtgcgcgagttcgtctttcggtgcgcgtggcaggcgcgtgaggccggcggcctcgaacagcacgacttcgttgtcgtcgcggccgaacgtcagcgggccgaggttgccgacgagcagcggcacgttcttgcgtttgcgcttctcgtcgccgtgcacgtcgaggtcgccgctttcggccgcgaacccgacgcagtacggcggatcgggcagcgccgcgaccgacgcgaggatgtccgggttctcgacgaatgcgagtgcgggcatcttgcggtcggccgtcttcttcatcttgtgctcggccggctgggcgacgcgccagtcggcgaccgcggccaccgcgatgaagatgtcggcgtcgttcacggcatgcatcaccgcgtcgtacatctgctgggccgtctgcacgtcctgccggtagacgccccacggcgtgtcgagcgcgaccggccccgcgacgagatgcacgtcggcgccggcctgctgcgcggcgcgcgcgagcgcgaagcccatcttgccgctcgagcggttcgtgaggccgcgtaccggatcgagcggttcgaacgtcgggccggccgtgatcagcacgcgccggtgcgcgagcaccttcggcgcgaagtgcgcgacgatcgcttcatagatcgcctcgggctcgagcatgcggccgtcgccgacttcgccgcacgcctgcgcacccgaatccgggccgagcaccgacacgccgtccgcgcgcagttgcgcggcattgcgttgcgtggccgggttctgccacatctggcggttcatcgcggggacgacgagcagcgggcaatcgcgcgcgacgcacagcgtcgacagcaggtcgtccgcgaacccgtgcgcgagcttcgcgaggaaatccgtcgacgcgggcgcgatcacgatcgcgtcggcttcgcgcgacaggtcgatgtgcgccatgttgttgtcgatgcgcgcgtcccactggctcgtatagacgggccggccagacagcgcctgcatcgtgacgggcgtgatgaactgggtggcggcttcggtcatcgcgacctgcacggtcgcgcctgccttcacgagcagccgcgtgagctcggcgatcttgtagcaggcgatgccgcccgtcagtccgagaacgaggtgttttcctgcgagttctgcttgtgccaactcaggcctccaagggtcgaacggaacggccggcgcgaagccggccgtcgacgccgagtatgcgcgcttagcgcgagccgcgcacgcgacgcagttcgtcgtagatcagcagcaccgcgccgatcgtgatcgcggaatcggcgaggttgaacgccggaaagtgccaggcgccgaggtggaaatcgaggaagtcgatcacgtggccgtagacgagccggtcgatcacgttgccgagcgcgccgccgaggatcagcgcgagcgacacgctgaacagccgctggtggccgtggcgcttcagcaggaagcagatcacgagcgtcgcgccgatgccgagcgcggtgaacgcccagcgctgccagccgctcgcggtcgacaggaaaccgaacgcggcgccgcggttgtacaccagcacaaggttgaagaacgacgtcagcgcatgctgcgcgccgtacacgaacgttttcaggatcgcgatcttcgacagctggtcgaacaggatcacgatcagcgaaatgccgagccagggcgcaagcgcgccgctggccggtttcgagagggttttcgccatattcaagcagcgctccggatttcgccgttttcgaacaggttggagaagcagcggccgcacagcgtcgggtgatcggcgtgcgcgccgacatcttcgcggtagtgccagcagcgttcgcacttctggtacttcgacgctgcgacgtcgacgctttcctgcgcttcgtcgtcgaccttgacgaccgtcgcggccgacgtgatcagcacgaacttgagatcatcgccgaggctcgtgagcgcgtcgtagcgtgcgccgctcgcatgcacggcgacttcggcctgcagcgacgaaccgatgcggttcgcggtgcgcgcttcctcgagcgccttcgtcacgttgccgcgcacgtcgcgcagcagcgcccacttctcgatcagcgcggccgagccggcgacttccggatacgcgtagtaggtttccgtgaagatcgtgtcgctggccggctggaacaccttccacgcttcttccgccgtgaacgacaggaacggcgcgagcacgcagcaggccgtgcgtgaggtggtacagcgcggtctgcgcggagcggcgcgcgcgcgaatcggccgcgctcgtgtacaggcggtccttcagcacgtcgaggtagaagccgccgagatcttccgagcagtacgtctgcagcttcgcgacgaccgggtggaattcgtacttctcgtagtggccgagcagttccgtctgcagttgctgcgagaacgcgaccgcataacggtcgatctcgagccattcgtcgacgggcaccgcgtgctgcgcgaagtcgaagtccgacaggttcgcgagcaggaagcgcagcgtgttgcggatgcggcgatagccttcggtcacgcgcttcaggatttcctcggagatcgcgagctcgcccgaatagtcggtcgatgcgatccacaggcgaatgatttccgcgccgaggcggttcgcgacttcatgcggatcgatgccgttgccgagcgacttgctcatcttgcggccttcgccgtcgaccgtgaagccgtgcgtgagcaggcccttgtacggcgcgcggccgtcgatcatcgatgcggtcaagagcgacgagtggaaccagccgcggtgctggtccgagccttcgaggtagaggtcggccgggaactgcagctgatccttgtgcgagccgcgcagcacgtgccagtgcgtcgtgcccgagtcgaaccacacgtcgagcgtgtcgcggttcttttcgtacaggttcgcgtcgtcgccgatcagctcgcgcgggtcgagcgtctgccaggcctcgatgcccgactgctcgacgcgcttcgcgacttcctcgagcagctcgagcgtgcgcgggtgcagctcgccggtttccttgtgcacgaagaacgccatcggcacgccccattggcgctggcgcgacagcgtccagtcgggacggttcgcgatcatgctgaacaggcgctgcttgccccacgacgggtagaacgcggtggcgtcgatgccttcgagcgcggtttcgcgcagcgtcttgccgccgtcgcgcggcgtcacgtccatgccggcgaaccactgcgacgtcgcgcggtaaatgatcgccgtcttgtgacgccagcagtgcatgtagctgtgcttgtagtgctcgctgcgcagcagcgagccggcctcgcgcagcgcgtcgacgaccttcgggttcgcgtcccagatcgacaggccgccgaacagcggcagcgattcgatgtagcggccgtcgcccatcaccgggttgatgatgtccgagtcggtcatcccgtgcgccttgcacgactggaagtcctcgatgccgtacgcgggcgacgagtgcacgacgccggtaccggtgtcggtcgtcacgtagtcgccgaggtagacgggcgcggtgcgcttgtagccggggtgagccgatgcgagcgggtggtggaagcgcaggttcgcgagcttcacgcccggcgcggtcgcgacgacgcggccggtcagcttgaagtcggtcatgcaggcttcgacacgttcttccgcgatgatcagcagcccgcgctcggtgtcgaccagcgcgtagacgatttccggatggaggttcagcgcctggttcgcggggatcgtccacggcgtggtggtccagatcacgatgccgccgtcggcgcgcggcagcgccggcaggccgaacgcctgcgcggtcttttccggttccgcgaacgcgaacatcacgtcgatcgtcgggtcggtgcggtccttgtactcgacttccgcttccgcgagcgccgagccgcagtcgaagcaccagttcaccggcttcagcccgcgatacacgtagcccttctcgatgatcttgccgagcgcgcggatctcttccgcctcgttgacgaagttcatcgtcttgtacggattggcccagtcgccgagcacgccgagacgcttgaagccgaccttctgcttctcgatctgctcggtcgcgtacgcgcgcgccttgctcatcacttcggccgccggcagcgacgccgaactgcttctcgatctggatctcgatcggcatcccgtggcaatcccagccgggcacgtacggtgcgtcgaagccggccatgttgcgcgacttgacgacgatgtccttcaggatcttgttgacggcgtggccgaggtggatgtcgccgttcgcatacggcgggccgtcgtgcaggatgaacttcggccggcccttgctggctgcgcggatcttctcgtagaggccgcgctcttcccattccttgacccactgcggctcgcgcttgggcaggtcgccgcgcatcgggaacggcgtgtcgagcaggttgaccggatacttggcctgcggtttcgaatcggctttcttgttgctcatgatgggatcgctatctaaatcgggagacgcgcgagcgtcgtgaatcggggatgcgcgcgagtgagcggcgcgaggtgcggcgccaggcgccgccgtccggatcagctaattcggtcggtggccgacgtcgagaagcccgtggcgcggctgcccggcgcacggtcacgctcgatgaagtacgcgcgtgcattcgcgacgtccagcgcgatcgcgcgcgacagcgcctcgagatcgtcgaatttcgcctcgtcgcgcagcttcttcaggaattcgacgcggatgagcttgccgtacgcgtcgccgtgccagtcgagcaggtggacctcgagcagcacgcggccggaatcgtcgacggtcgggcgcagcccgaggctcgcgacgcccggcagcggggtggggccgaggccgtgcacctgcacgacgaagatgcccgcgagcgccggacgcttgtgcgcgatcggcaggttcagcgtcgggaagccgaggtcgcggccgagcttcagcccgtgcgcgacgtggccgctgatcgcatagccgtggccgagcgcctgcgcggccgcgtcgagatcgcccgcggcgagcgcggcgcgcacgcccgagctggagatgcgcgtgccgtcgctgcccgcgaccgtacccatctgctcgacctcgaagccgtactgttcgccggccgccttcagcgtgtcgaaggtgcccgcgcgcttcgcgccgtagcagaaatcgtcgccgaccatcatccagcgcgtgtgcagcccgccgaccagcgtgcgttcgacgaacgcctgcggcgactggctcgcgaacgtgtgattgaagtgctcgacgacgacgcggtcgacaccgtggtcgcgcagcgctcgagcttgtcgcgcagcatcgcgatgcgcggcggcgcgccggcgggattgaagaattcgcgcgggtgcggctcgaacgtcatcacgcacacgggcaggccgcgcgcgtccgctgccgcgcgcacgcgcgcgagcagggcctggtggccgcgatggacaccgtcgaagttgccgatcgtcagcgcgcacggggcgcggctctcggcgttgggcaggccgcggaagactttcacgatagcggatgcagcgtcggggaatgggcggtgggatgccgcaaagcagaagattataaacgttcgggcgggccggcggccgagaaggcgggaaaggcgggggcgaatggtaaaattcgcggatgaaaaactcgtgatcctgatttccggtcgcggcagcaacatggaggccatcgtccgcgcgtgcgcgcaggaacgctggccggccgagattgccgccgtgatcgccaaccggcccgacgcggccggactggcctttgccgcgtcgcacggggtggcgacggcggtggtcgaccaccgctcgttcgacggccgcgacagcttcgacgcggcgctcgccgccgagatcgaccggttcgcgcccgatcttgtcgtcctcgccggcttcatgcgcatcctcacgcccgcattcgtcagacgatacgaaggccggttgctgaacatccatccgtcgctgctgccgagcttcaagggcatccacacgcatcagcaggcgctcgacgcgggtgtcgcgctgcatggcgcgagcgtgcatttcgtcatccccgagctcgacagcggcgcgatcgtcgcgcagggcgcggtgcccgtgcgcgcgggcgacgacgcggcggcgctcgcgcagcgcgtgctggcggtcgagcatgtgctgtatccgcgcgcggtgcgctggttcatcgagggccgtttgcgcctcgagaacggccgcgcagtggtggcgccggaagaggcgcgctggattttcgcggatcaaccgcataccgaaacgagtgagggcgtatgaagctgcacggattcctgatcggccagaccgagactttgctggccgaggtgctgaagttcgccggccccgccgacgcgacgacgagccggttcttccgcgcgcacccgaagctcgggcacgcggagcgcggcgtgatcgccgaggcggtgttcgcggtgctgcgccggaaaatggagttttcgcacctcgccgagagcggcaccggtacgccggcacgacgcctcacgctgctcggcctgatgcagacggtcggccgcaatgcgctgaagccgttcctgtcggacaccgagtcggcctggctcgagcacgtgtcgaaaatcgacccggcgagcctgcccgtgcgcattcgcacgaacctgcccgactggattcaccaggcgctgtcggcccgtttcgacgccgacgagctcgcgcagcttgccgccgcgctgaactatccggcgccgctcgacctgcgcgccaacgcgcagaaggcgagccgcgaccaggtcatcgacgggctgcgcgcgagcggcatcgacgcgggcgcgacgccgttcgcaccgttcggcgtgcgcgtggtcggcaagccggcgctgacgcgcctgaagctgttcgaggaaggcgcgatcgaggtgcaggacgaaggcagccagctgctgtgttcgctggtcgcgccgcgccgcggcgagatggttgtcgatttctgcgcgggcgcgggcggcaagacgctcgcgctgggcgcgatgatgcgctcgactgggcgcctctatgcgttcgacgtgtcggagaagcgcctcgcgaagctgaagccgcgcctcgcacgcagcgggctgtcgaacgtgaacccggtgctgatcgacagcgagcacgacgcgaagatcaagcggctcgccggcaagatcgaccgcgtgctggtcgacgcgccgtgcagcggcctcggcacgctgcgccgcaatccgacctgaagtggcgccagacgcgcaccgcgatcgatgaactcacgccgaagcaggcgtcgatcctcgcgagcgccgcgcgtctggtgaagaagggcggccggctcgtctacgccacctgcagcgtgctcgacgccgagaacgaacgcatcgtcgagcagttcctggccgaccatcccgagttcgtgctggtgccggcgcagaaggtgctggatgaccagcgcatcgcgctcgagaccggcgactacctgtcgttgtggccgcaccgtcacgcaaccgacggcttcttcgccgccgtcctcgaacggcgcgctgcgcagtaacgaccgcccggactgacgatggaaaatctgcagagccgcctgctgtcgcatcggctggaatcggtcattcgtgactttcaccaaccggtgatgatctggcaggcggcgatcctcgtcggcgcgctgtgtttcgcatgggtgaccgcgcgcttcgtgcacggccgcatcgatgcacgccgccgggcggccggccgcgcacccggcgcgggcgcgcaaagcctgaagcgcgcgctgttcccgttgttcggcagcgtcttcgtcggcgccgcgcagctcgcgttcgacccgttcatgtcgacgtcgctgctgtcgctggcgctcgtgccgctgttcggcatcgggctgatctacgtgctgttcttcttcgcgcggcgcgtgttcgcgcgcgacggccacacgcatgcgtggctgtcgatcgtcgagaagatcgtgtcgaccgtcgtgtgggccgcgatggtgctgaccgtgctgggcattcagcgcgacgtgctgggctggctcgacagcgtgcagttccgcgtcgccaacgcgcacctcacgctgctgtcggtgatttccggcgcgctgtgggtatgcgtgacgctgatggtcgcgatgtggctgggctcggtgctcgaggatcgcctcacgcgcgcaagcacgctcgacgcgaacctgaaggtcgtgctgtcgcgggtcggccgcgcgctgctggtattcgcggcgatcctgatcgggctgtcgctggtcggcatcgacgtgacggtgctcggcgtgttcggcggcgcggtgggtgtcggcctcggtttcgggctgcagaagatcgccagcaactacgtgtcgggcttcatcatcctgctcgaccgctcgctgcggctcggcgacgcgatcagcgtcggcgggctgcagggcgtcgtcacgcagattcgcacgcgctacacggtcgtgcgcggcctcgacggcaacgagacgctgattccgaacgagaagctgatcaccgacgtcgtgcagaaccagtcgtcgtacctgacgcgcggctacgcgaaggttgcggtgcaggtcgcgtacaccagcgatgtcgagcacgcgctcgtgttgctcgccgatgcggccagggacgtgccgcgcgtgctggcggagccggctccgaccccgtatctggtgagtttcggtgcggacgggatcgacctggagctcggtttctggatcgaggattcggcgaaagggacgtccggcgtgcgttcgaccgtgaaccgcaatatctggcggctgttcagcgagcacgggatttcgatcccgttcccgcagcgcgaagtgcgggtcgtggggctgcccgacggcttttcttccgccggcgtgtcggccggcaacggcgcggcggacgggcgcgcgccggctgcgtagcgcaagccggtcgccaaatgtgtcgaccccgcggtcggaaccggatcgcgggccgttccaagtccgcccatggactgcgcctgttgcgtcagggcaagaaaatgttcatttttacaaagacttggaacggttgaagtaaaattctggtctacacgcggtatgctttcatttttctgacgcttggcgcgggccggcgtcgctctcatcacaggtaactgccttgttgaattccctgctcgattttctttcccacgggctcctgcattttcgtggtggcaggtcgcgctgttcgcgctcgccgtcacgcacgtcacgattatcggcgtgacggtctacctgcaccgctgccaggcgcatcgcgcactcgagctgcatccgatcgcgagccacttcttccgcctctggttgtggatgacgaccggcatgctgacgggccagtgggccgcgattcaccgcaagcaccatgcgaagtgcgagaccgaggaagatccgcacagcccgcagacgcgcggcatctggaaggtgttcctcgagggtgccgagctgtaccgcgcggaagcgaagaatgaagagacgatgcgcaagttcagccacggcacgccgaacgactggatcgaacgcaatatctactcgaagtacccgatcctcggcgtgagcctgatgatggtgatcgacgtcgcgctgttcggcgtgctcggcctgaccgtctgggccgtgcagatggtctggattccgttctgggcggctggcgtcgtcaacggcttcggtcacttctggggttatcgcaacttcaactcggccgacgcgagcacgaacctgttcccgtggggcatcgtgatcggcggcgaagagctgcacaacaaccaccacacgttcgcgacgtcggcgaagctgtcgaacaagtggtacgagttcgacatcggctggatgtacatccgcatcatgtcggcattcggtctcgcgaaggtgaagaaggtcgcaccgacgccgcgcctgaacaagccgaagacggtgctcgaccaggaaacgctgcaggccgtgctgtcgaaccgctacgaagtgatggcgcgctacggcaaggccgtgaagcgcgcataccgccaggagctcgcgcacctgaaggaaatcggcggcgagaagtaccagctgatgcgcggtgcgcgcaagtggttccacaaggatgccgacggcctcgacgagccgcagaagaagctgctgccggaaatcttcgcgaacagccagaagctgcacacgtacttccagctccgccaggatctggccgcgatctgggatcgttcgaccgcgtcgcgcgaacagcttctcgcgcaattgcaggattggtgccatcgcgcagaacaaagcggcatcaaggcgctgcaggaattcgcgacgcgcctgcgccgctacgcctgattcgaaatcgattagaatctaaggacgtcaaaaccccgcgttggcggggtttttatttgggcttccggttttgaaggtgatcggcagggccggatttgtatgaggcttggggcagcggcgaatggttgccccggggcgagcacagggtgaggccggaggggcgccaaggcgctgatgctggtcgaccgcgaagcatggatcgaagtaagcgctaaagcactaacttggatcgaccgcgaagcatgggatcaagtaagcgctaaagcgctaacttggatcgacaggagatatggagatgcaatcgacgatcaaacccgtcgaatacgatcggcccgtcgcagcagggaccgcgtgcggcgtggggcaggcatgggccaaggtgcccgacgcaccgtccgccgaagagcgcgctgcactgaaggcacgtatcaaggcgctgctcgtgcgtgaaaaggccgtcctggtcgcgcactactacgtcgacgccgaattgcaggaactggccgacgaaacgggcggctgtgtcgccgactcgctcgaaatggcccgcttcggccgcgatcacgacgcgcagacgctggtcgtcgccggcgtgcgcttcatgggcgaaaccgcgaagatcctgagcccgaacaagcggatcctgatgcccgacctcgatgcgacctgctcgctcgacctcggctgcccggtcgacgaattctcggcgttctgcgatgcgcatcccgaccgtaccgtcgtcgtctacgcgaataccagcgccgccgtgaaggcgcgcgcggactggatggtcacgtcgtcgatcggcctcgagatcgtggccgacctgcatgcgcgcggcgagaagatcatctgggcgccggatcgccatctcggcagctacatccagaagaaaaccggcgcggacatgctgttgtggcaaggctcgtgcctcgtccacgacgagttcaagggcatcgaactcgacctgctgcgcgccgagtatccggacgcgaaggtgctcgtccaccccgaatcgccggaaaatgtcgtcgcacaggcggacgtcgtcggctcgacgacgcaattgatcgacgcagccgtgaagttcgacgcgacgcgcttcatcgtcgcgaccgatctcggcatcctgcacaagatgcagcttgcggcgcccggcaagaccttcatcgccgcaccgacggccggcaacagcgcaacctgcaagagctgcgcacattgcccgtggatggcgatgaacggcctcgcgaacctcgccgacgtgctcgaacgcggtcacaacgagatcttcgtcgatcccgcgatcggtgagcgtgcacgtctgccgatcgaccggatgctcgatttcgcagcggcgcacaagaagcgcgtgcaggcgagcggcgatctgcagcgcgaccagcaactgtttgcgaacgtggggctgcatgacgaacgcagccgtatccccgctgttcgacgtcgtccgcgagcaatacggcgcggcattcgacgatgcgatcgcgcgcaacgtggccgatgcgatcgcggaagacgtcggcacgggcgaccagaccgggcggctcgtgccggccggcgggcgtcgccgggcgcgcatcatcgtgcgcgaggacgccgtgctgtgcggcgtaccgtggttcgaggccgtgattgcacgaatcgatccggcgatcgtcgtggaatggcgctatcgcgaaggcgaccggatgacgcccgattcgaccgtctgcgaactcgaagggccggcgcgtgcactgctgacggccgagcgcaacggactgaacttcctgcaattgctgtcgggtgtcgcgactgcgacgcgccgttacgtcgagcgcgtcgaaggcacgcgcgcgaagatcctcgacacgcgcaagacgctgccgggcctgcggctcgcgcagaaatacgctgtgcgtgtcggcggcggcgagaaccagcgtcttgcgctgtatgacggcatcctgatcaaggagaaccacatcgcagcggcaggcggtgtcggcgaggcactcgacgcggcgtttgcgctggagtcgggcgtgcccgtgcaggtcgaagtcgagacgctcgcgcaactcgatacggcgctcgcgcaccgcgctcagtcggtgctgctcgacaacttcacgctcgacatgatgcgtgaagcggtgcgtgtcgcgaacggcaaggctgtgctcgaagtgtcgggtggcgtcaatttcgatacggtgcgtgcgttcgcggaaacgggtgtcgaccgtatctcgatcggcgcgctgacgaaggacgtgcgcgcgacggactattcgatgcgtatcgtcgactgaccgcgcgacataccgtctgacaaaaaagccgctggcgcgcaaacgtcagcggctttttcgtgggccgcagccgggaacggcgtggcggtcagcggcgcgagcggggcgtgagcacgctcggcagcgccttcggcagcgtgtgcggccagtcgcggctgtagtgcagcccgcggctttcgcggcgcgagtacgcgcttttcacgatcagtgtcgccacgtcgacgaggttgcgcagttcgagcaggtcgcgcgtcacgcggaagttcgcgtagtactcctggatctcgtcgcgcagcagcgacagccggtgcttcgcgcgttcgagacgcttgtcggtacgcacgatgccgacgtagttccacatcaggcggcgcagctcgtcccagttgtgcgcaacgacgacttcctcgtccgcatccgacacgcggctttcgtcccacgcgggcagcgtggcgggcgtttcggcatcgaagccggccgcctcgatcgcgtcggccgccgcgcggccgatcacgagacattcgagcagcgagttgctcgcgagccggtttgcaccgtggagcccggtgtacgacgtttcgccgaccgcatacaggcccgcgagatcggtgcgcccggcgagatcggtgacgacgccgccgcacgtgtagtgggcggccggcacgacgggaatcggctgcttcgcgatatcgatgccgaattcgaggcagcgcgcgtggatcgtcgggaagtgctcgcgcaggaacgcttctggctggtggctgatgtcgagatacacgcagtcgatcccgcgcttcttgatctcgaagtcgatcgcgcgtgcgacgatgtcgcgcggtgcgagttcggcgcgcggatcgtgcgcgggcatgaagcgcgtaccgtcgggcagcttcagcaggccgccttcgccgcgcacggcttccgagatcaggaacgactttgcatagggatggaacaggcaggtcgggtggaactggatgaattccatgttggacacgcggcagcccgcgcgccacgccatcgcgatgccgtcgccggtcgcggtgtcggggttcgtcgtactctggtagaccttgccggcgccgccggtcgcgagcaccgtatgcggcgcctcgatcgtgatcgtgcggtcgttgtcgacgtcgagcgcatacaggccgtgacagcggcggccgggcaggccgaggcgatccgacgtgatcaggtcgatcgcgtggtggttttcgaagaacgtaatgttcggatgctggcgcgcccgcgccgacagcgtcgcgagcaccgcgtggccggtcgcgtcggccgcgtggatgatccggcggtggctgtggccgccttcgcgcgtgaggtggaagccgagctcggctgcgtcgtccttcgtgaacggcacgccctgggagatcagccattcgatcgcttcgcggccgtgctcgacgatgtagcgcgtcgcgccttcgtcgcacagcccgccgccggcgaccagcgtgtcgtcgacgtggttctcgatgctgtccgccgaatcgaggacggccgcgatgccgccttgcgcgttatcgcttgctccctccatcatcgaacgtttcgcgatcagcgcgacacgtcgcgtgctggccaggttgagtgcgaccgacagccctgccaggccgctgccgacgatcgccacgtcgaatttcatgctgcatctccatcgttacgcttttgatcttgtgcgttccggcggccgcagccgcggaaaggagagcataccgcgtcgcgccggagcgtgcgcgcaaaacaaaaagccccgcatgtgcggggcttttcggtcgccgtcaggctggcagaaaccggagattacttgatcttggtttctttgtattccacatgcttgcggacgacgggatcaaacttcttgatcgccatcttttccggcatgttgcgcttgttcttcgtggtcgtgtagaagtgacccgtaccagcggtcgactcgagcttgatcttgtcgcgtgcgccttttgccatgattgtgctccttgggcttaggcttcgccgcgtgcgcgcaggtcagcgagcacggaatcgatgccgttcttgtcgatcaggcgcaggccggcgttcgagacgcgcaggcgcacccagcggttttcgctctccacccagaaccggcggttttgcaggttcggcaggaagcggcgcttcgtcttgttgttggcgtgggaaacgttgttgccgctcatcggcgctttcccagttacttggcatacgcgtgccatgagagcactcctaatacgctaaattcggggttcgatcgccgatgaaggttccatcgtaccgccacgtgatccatggctgcactcagaacgccgaagcccttacagacaaggcccttcgatggctagaactggttggaaaaagacagacggcgattctagcagaaaaagttcagaaaaatcaaacctaatttcgcatcgccgttgcggcgccctcaggcgggccgcaaccgcacagtctacagccaaccggcccgtgcgaacgaaaaagtatcactggtgccgatgacgacgtgatcgagcagctgaacgtcgacgagcgcgagcgcgtcgtgcagcacgcgggtcaggcgccgatcctccgcgctcggctgtaccgcgccggacggatggttgtgcgcgacgatcagcgccgcggcgttgtgcaccatcgcgcggcgtacgatctcgcgcgggtagacggccatgcgcgtcagcgagccgcgcgtgatttcctcggtgtcgatcaggccatggcgcgcgtcgaggtagaccgcggcgaacacttcgtgcgggcgcgcaccgatcttcatccgcagatagtcctcgaccgcgccgggcgaatcgatcagcctcttctcgcgcgctttctccttcagcacgcgccgcgcgatctcggtgaccgcaaccagccgcgcggagcgcggggccgatgccggggtgcgcctcgaaatcgtcggcggttgcctcgagcagcccgcgcaacgtcttgaactgcccgaccagcgcgcgggccgtgacgaacacgtcgtgccccggctggccggtgccgagcagcagggcgatcagttcgtcgtcggtcagcgcggccgacccgcgctccagcaatcgctcgcgcggccgctcgggccgccagtcgcgcgggcggcgcttgcgccggcggatcgggaggccgcggccgggcggagcggcaggcagatcggcggtgtcgcggcattcgacgggcggcggggtgaggcagggtgacagcatgctcgaaactccattggcggcgggcggtgtgcgcgacgtcgtcgcactttccgccttgcgcgctcaggtgacttacaatattggctttgcgccgggcctttcggccgtatcgggcgccgaccgaacgagtaattcatgagcctcatcgatctatccgaagtgaagcccggttcccacgtcacgttgcattaccggctggcactggccgacggcgccgacatcgtcaacaccttcaccgacaagccggccacgctgctgctcggcgcggggcaactggcgccgtcgctggaacagattctgatcgggctcagggtcggcgaccattcgacttttcagctaacgcccgaacaggggttcggtccccgcaatcccgacatgctccagcgcgtcacgctgtcgacgctgcgcgagaacgggatggtcggcgacgatttcacgccgggcgaactgatcgagttcaatgcgccggacggcggccggtacgcgggggtgctgaaggaagtcagcgaaacctcggcactgttcgacttcaatcatccgctcgcgggccaagcgctcacgttcgaagtgaaaatcatcggaatcctgtaatcatgagcaccaccgatacgctgtccgggcagaccgtcgcagccgacgccgaaatcctgttggcccagccgcgcggtttttgcgcgggtgtcgatcgcgcgatcgagatcgtcgagcgcgcaatcgcgatgcacggtgcgccgatctacgttcgtcacgaaatcgtccacaacaagtacgtggtcgaggatctgaagaagaaaggcgcgatcttcgtcgaggaactcgaggaagtgccggccggcaataccgtgatcttcagtgcgcacggcgtgtcgaaggccgtgcgcgacgaggccgacgtgcgcgggttgcgcatttacgacgcaacctgcccgctcgtcacgaaggtgcacgtcgaagtggcgaagatgcgccaggacggcgtcgacatcgtgatgatcggccacaagggccatccggaagtcgaaggcacgatggggcaggtcgaacgcggcatgcatctcgtcgagagcgtcgaggacgtgcagaagctcgagctcgccgatcccgagcgcatcgcgctcgtcacgcagacgacgctgtccgtcgacgatgcagccgagatcatcggcgcgttgaaggccaagtatccgaaaatccgcgagccgaagaagcaggacatctgctacgcgacgcagaaccgccaggacgcagtgaagttcatggcgccgcaatgcgatgtcgtgatcgtcgtcggcagcccgaacagctcgaattcgagccgcctgcgcgaagtggccgagaagcgcggcgtggacgcctacatggtcgatgcacccgaccagatcgacccggcatgggtcgcgggcaagcgccgcatcggcgtgacggccggcgcgtcggcacccgaagtgctcgcccaggccgtgatcgcgcgcctgcgcgagctcggtgtgcgcaacgtccgcgcgctcgaaggcatcgaggaaaacgtgtcgtttccgctgccgcgcgggttgaacctgccgcccgccgcgtgattgacgcagcgcacctgcggacacaccgaagcgcctcccggcgcgcttttacccgtcggaattgcaatcgcaaccattctccgcattcatggtgcaaccgggttgctcctgtcgttttcaagcgtctctcaaaattggttgcaatgcaggaaaaccccatcgaatcaggattattggcgtcctataaatggagttacaatgcgcccgttttcaggcctgaatggctttgaaatcgggttttggcaaggcgcgggagaccattcgatgcatgtgaagttggcttacgccgtgtccgtcgccgcaccggttgcaatgcttgccggttgcagcaaaagagcgacggcggggcgggagaggaggctgcggtgttcgcggcaccgccggccagcggcgtgcgcgtcgccggaaccgttcgtgcggcaccgttcgcgtgccgcatcgcgcaattgggcaaggacaaggaaaacggggcacgtttggcgatcgaggaaatcaacgcgcttgacctggcgaacggtcaagcagcgggcacgcaggttgcaatgcagcaagccgccggtcgtggcgtgacagcgaccgtgcgcgccgatcgacgcaggccggccatggtgcccggcgctgcgggcagcgtgccgatgtcgccggcccctttcatttcgattcgacgaaacagcgtgttgccgcgagcaatggtgtcgcggcgcgcggcctgattcgtacgatggattccgacgcagtcctgacgaatgtcgggcgcggcgttcgcggtgcctcgcggggcggcgcgacacggaatccgatctgcccggatgcggggctcgcctcgcaccggacgggaaaaggcacggatgccgggcaaccggacgatggccgtctcggcatgctgccctacgacttcaaggaggccacgaacaccgtcctcgatgtcgtgacgatttagcgacgggactcatgacggcaccggaacagtgcggtgccgtttctgtatccgctccggcggcaagtccggccgtacaggccgggcggcgcgcgccgggacgatccacccttaccggtatcgactagtacccgcagtgtcgccgagaaggcgcgattcctcgcttacccgcggggcgcaccgtcctccggcagcacgggccaaggagctttaaatggatattttcgtccagcaggttctcaacgggctggtgctcggcagtgtctacgccatcatcgcgttgggctacacgatggtgtacggcattctcggcatcatcaacttcgcgcacggcgacgtgctgatgatcggcgcgatggtcgccttgtcggccatcaccgtgctgcagaaccatttccccggactcggcaacgtcgcgacgctgacgatcggcctgggcatcgccgccgtcgtctgtgcgttcgtcggcttcacgatcgagcgggtcgcataccggccgctgcgccgcgcaccgcgcctcgccccgctgatcaccgcgatcggcgtgtcgatcctgctgcagaccgccgcgatgatcatctggtcgcgcaacccgctgccgttccccaattgctgccgaccgatccgatcaacgtgatcaaggcgaccgacacgacgcccggcgccgtgatctcggttactgaaatcgtgatcatcgcggtggcgtttatcgtgatgggcggcctgctgctgctcgtgcacaagaccaagctcggccgcgcgatgcgcgcgatcgccgaaagcccgaacaccgcgagcctgatgggcgtgaacccgaacttcgtgatctcggcgacgttcatgatcggctccgcgctcgccgcgctggccggcgtgatgatcgcgtccgaatacggcaacgtgcacttctacatgggcttcatccccggcatgaaggcattcacggccgcggtgctgggcgggatcggcaacctcggcggcgcaatggtcggcggcgtgctgctcggcctgatcgagcagctcggggccggctacatcggcaacctcacgggcggtgtattcggcagtaactaccaggacgtgttcgccttcgtcgtgctgatcatcgtgctggtgttccgtccgtccggcctgttgggcgaacgtgtcgcggatcgcgcgtaacggaagggagcaaacaacatgacatccattcaaccgattgaatcctcgacgtcgctcgtcgaagagcgcaacaccgccaagaccgtcatcatcggcatcctgaccgctgcgttcgtgatcgccgcgccgatcatcatcggctcggccggcggcaactactgggtccgcgtgctcgacttcgcgatgctgtacgtgatgctcgcgctgggcctgaacgtggtggtcggcttcgccggcctgctcgacctcggctatatcgcgttctacgcggtgggcgcgtacacggcggcattgctgagctcgccgcacctgacctcgcagttcgagtggatcgcggcgctcgcgccgaacggcctgcacatcccgttcctgatcatcgtgccgatcgcgatggcgctggcggcgaccttcgggatcctgctcggcgcgccgacgctgcgcctgcgcggcgactacctggcgatcgtgacgttgggcttcggtgaaatcgtccggatcttcatgaacaacctcgaccgtccggtgaacatcaccaacggcccgaaggggatcacgggcatcgatccggtgcacgtcggcggcttcaacctgtcgcagacgcactcgctgttcggcctgcagctgccgtcggtctacatgtactactacctgttcgtgctgtgctcgctgctggtgatctgggtgtgtacgcgcctgcagcactcgcgtatcggccgtgcctgggcagccatccgcgaagacgaaatcgcggcgaaggcgatgggcatcaacacccgcaacgtgaagctgctcgcgttcgcgatgggcgcgtcgttcggcggcctgtcgggcgcgatgttcggtgcgttccagggcttcgtgtcgcccgagtcgttcacgttctgggaatcgatcgtcgtgctcgcctgcgtggtgctcggcggcatgggccacatcccgggcgtgatcctgggcgcggtgctgctcgcgatcttcccggaattcctgcgctcgacgatgagcccgctgcagcacgcgctgttcggtcatgacgtcgtcgatacggaagtgatccgtcaggcgctgtacggcctcgcgatggtggtcatcatgctgtaccgctcggaaggcctgtggcccgcgccgaagcatgaggacaagatcgcgaaactggcgaagcgcaacagcaagaagccggtgcgcgcttaacctacggacacaggggatatacacatgagcgacaagcaaatccgactgtccgtcaagggcgtgaacaagcgcttcggtggcctgcaggcgctgtccgacgtcggcctcgagatcaaggaaggcgagatctacgggctgatcggcccgaacggcgccggcaagacgacgttcttcaacgtgatcacgggcctctacacgccggactcaggcgagttcaagctcgacggctcggaatacaagccgactgcggtgcaccaggtcgcgaagacgggcatcgcgcgcacgttccagaacatccgcctgttcggcgggatgacggccctcgagaacgtgatggtgggccgccacgtgcgtaccaagcacgggctgctcggcgcggtgttccagacgccggccgaacgccaggaagagcgcgagatcaaggaacgcgcgatcgagctgctcgaatacgtcggtgtgctgcagtacgccgactacacgtcgcgcaacctctcgtacggccaccagcgccgtctcgagatcgcgcgcgcgctggcgaccgacccgaagctgctcgcgctcgacgagccggcggccgggatgaacgcgaccgaaaggtcgaactcacgcgcctgctcgacaagatccgctcggacggccgcacgattctgctgatcgagcacgacgtgaagctcgtgatggggttgtgcaaccggatgacggtgctcgattacggcaaggtgatcgccgagggtctgccgcaggacgtgcagaagaatccgaaggtgattgaggcatatctcggcgcaggggtgcactgatggcagcggcaatgttgaaaatcaagggcttgcaggtcaactacggcggcatccaggccgtcaagggcgttgacatggaagtccgtcagggcgagctcgtgacgctgatcggcgcgaacggcgcaggcaagaccacgacgatgaaggcgatcacgggtctcaagccgtattcggcgggcgacatcgagtacgacggcaagtcgatcaagggcgtgccgacccacgagctgctcaagcgcggcctcgcgatggtgccggaaggccgcgggatcttcgcgcggatgtcgatcgtcgagaacatgcagatgggtgcgtacctgcgcaacgacaccgagcagatcaagaaggacgtcgaccgcatgttcggcttcttcccgcgtctgaaggagcgtgcgacgcagctcgcgggcacgttgtcgggcggcgagcagcagatgctggcgatgtcgcgcgcgatcctgtcgaagccgaagctgctgctgctcgacgagccgtcgatgggcctgtcgccgatcatggtcgagaagatcttcgaagtggtgcgcgagatctcgaaggagggcatcacggtgctgctcgtcgagcagaacgcacgcctcgcgctgcaggcggccgaccgtggctacgtgatggattcgggcacggtcacgatggaaggcgatgcgaagcagatgctcgacgatccgaaggtgcgtgccgcgtatctcggtgaatgagtgagtgaatgagcgggcccggtggcgcgcgacggcaggtgccgggcgcgtcgcacacgggctgtcgaaaggctgtcacgggatgccgtgacagcctttttcgtgtcatgcgatccggggcgaacttgtgcgtgcgggcgcgactccattcgactgttgcgctgagcacgcgacgcgggaacgatggggcagggccgcccgaagccggtcgcccgaagccggtcgcctgcaaaccgacacacgggccgtgtagcatcgacggcccatcgggacacggagagcacgcatgagtctggactacggtttcgtgaaggcgaaggtgacatcggtggcgaagctgaagggctcgccgcacggcagcgagatccagtatcacatccacctgacgctggcgttgccgggcggcaactgggacgtcgcgatcaacgtcggcaccagcgacgcggacgacttgctgaactacaagctcgtctacgatttccaccacccgatcacgcagacgctcgcggccgcggccgaaggctataccgacctgacggggcaggccgcattgcccgcgctcgactacctgcgcagcgacatcctgaacgaaacgggagcgtggcgcgcgagcgccgtgatggacggcacggagaatccggagccgatcccgtcgctgctgcggctcgtgaacgccgcgcagtcgcaggggctcgacgtcgtcgtgttcggccgctcgtatgccgaaggcaacggcatccacgacacgcacatgaaccagggttcgacgggctcgaactacgtgcaccgtgcgggcgacgaccacaacgaccacaacgacatctggcaggacggcgcgctgatcgtgcgcgtgagcgacacgcagtgggccgcatatttcgccgcgttcgagcagcaggccgtgccgaccgacgcgctcggcaatccgctgccgggcgcggggccgatcacgcgctgagatcgccggcggccggctttcgcgtcatgcggccggcagcgtcttgccgaacgagatgcgttcctcgacgcggtagccgagcgccgcgtagaagcggcacgcgtcgtcgttgcccggcagcacctgcaggttgatcttcaggcagccgcgcgcggcgagcgcgcgttccgcatgcgcgatcagcgcgcggccgatgccgagccgccgcgcgtcgttcgatacgccgaacgagtagagccagccgcgatgtccgtcgaaacccgccatcagcgtgccgacgacgcgtgcgccgctggtcgcgacgaaaaacagctccggctgcgtcgcgagcttcagctcgatcgatcgcatcggatcgcggtgcggcggcgcaccggcttcgtcgtactgcgggaacgcgtcgcgccataccgcgagcacggcatcggtgtcggcgcgttcgaacgggcggattgcgacagcatcggcggcggcatccatcggcgggctctcctcagagcgtgtcgagaaccgaccgcagcatcgccatcatctggtcgatctcttcggtcgtcacgttcagtgcgggcatgaagcgcagcaggttcggccgcgcggcgttcagcagcaggccgtcgggctgcatgtcgcgtgccttctcgacgatctgcgggccgatgtccttgccgagcagcagcgcgcgcagcaggccttcgccgcgttcgccttcgaaaccgcgctcttccgacagctcgagcagcttgcgcttcaggtattcgctgcgcgcgcgcacgccttcgaggaagccgggcgcgacgagctgcgagatcaccgaatagccgaccgctgtcatcagcgggttgccgttgtacgtgccgccctggtcgccggcctcgaacaccgcgacctcggccttcgacagcagcgcgccgagcgggcgccgccgccgatgcctttcgcgagcgtcatgacgtccggctcgatgccggacagctcgtacgcgaacagcgtgcccgcgcggccgcagccgctttgcacctcgtcgacgatcagcagcaggttgtgctgcttcgtcagcgcgcgcagcgcctgcatgaattcgcgcgtcgccggaatcacgccgccttcaccctggatcggctcgagcatcaccgcgacggtcttgtcggtgatcagcctctcgaccgagttgatgtcgttgagctcggccttcgggaagcccggcacctgcggtgcgtagatcgtgtcccagcccggcttgccgctggccgacatcgtcgcgagcgtgcggccgtggaagctgtggtcgaacgtgatgatctcgtaggcgccgttcttgaacttgcggccccacttgcgcgcgagcttgatcgcgccttcgtttgcctccgcgccgctgttcgtgaagaacaccttgtcgaacacgctgtgctgcgtgagcaggcccgcgagcttcgccatcggttcgttgtagaacgcgggcgacgggttcagcagcttttccgcctgggtcttcagcgcttcgacgatgccgtcattgcagtgtccgaggctgttgacggcccagccctggatgaagtccagatagcgcttgcccgtgtgatcgtagagccacgaacccttgccgtgcgtaaacacgatgtcggggcggttcgtgatgtacatcagcgagtcgatcggataatcgttcagggcatggcagcagactccagcgggcgttgaaagggaaacaggcaataaaaagccacggaaggccgtggctggtgggtcgaacagcttgtgcgtaaccggtgaggcggtgtggggttacgcgcgagtccgtgacgagcctgcggcatccgggcggagcggcgagcggcgacgtcgaagggcggacaggaagcagttcatgtgcgcaagcataaggcatcccgcgcctcactgtaaaccgccgcgatgccacggatgtgacatcgcggtgcgggacgcgggtgcgcgggtgtcagaccggatgcgcgagatcggcggcgctcgtgaacgagtcggcgtagaactcgtcagccggcagtgcgtggtgctgcgtgaagtcgcgctgcgcggattcgaccatcaccggcgcgccgcacgcgtacacctggtagcccgacaggtcgggcagatcctcgatcaccgcgcgatggacgaagccggtgcggcccgtccactggtcgccggcgtccggctcggagagcaccggcacgtacttgaaattcgggatctcgcgtgcccactgctcggcgagctcgtcgaggtagatgtccttcttgcggcgcgcgccccagtagagcgtcatcgggcgcgtgatgcccgtgtgcttcacgtgctcgatgatcgccttgatcggtgcgaagcccgtacccgatgcgagcagcacgatcggcttgtcggaatcctcgcgcaggaagaacgtgccgagcgggccctcgaagcgcaggatgtcgcgctccttcatcgcgccgaacacgtggtcggtgaacttgccgcccggcatgtggcggatgtgcagctcgatcgggccttcctcgtgcggcgcgttcgccatcgagtagctgcggcgcgagccgtccttcaggatgaactcgacgtactggcccgcgagatactgcaggcgttcgttggcgggcaactgcagcttcacgaccatcacgtcgtcggccttgcgttcgagcgcggcgatccggcacggcagcttcttgacctgcacgccgtcgacgccggcgatttcgcgcacgtcgatttcgagatcgcactgcgccttcgagcagcacagcagcgcgaggccgcgcgtgcgctcgtcgttggacagcgccgacgcggcgtgcgggccctgttcgatctggcccgacacgatctggcccttgcaggagccgcacgcgccgttcttgcagccgtacggcagatggacgttctggcgcagcgcagccgccagcacggtttcatccgactcgacctggaattgccggccgctttgcttgagagtgacgttgaatgccatagaaccaaactagaacaaaatgtggggaccgtgcatgtcgagcacggcagctacaataagcccgttgcgcgtcgcgcaacggtggctactgatttcgcaaccaacatgatcgcgactcgaatcctgcgccggccgcgcgcattgatcgtcggctgcggcgacgtcggcatgcgctgcgttgcgcaatggcgcggcacgcatcgcaacctgcggatcttcgcgctgacgagccacccggcccgccgcgacgaactgcgtgccgcgggcgcgacgccgatcgtcggcgacctcgatcgccgggcgacgctcggccgcctcgcgggtctggcccgcacgatcctgcatctcgcgccgccgcaatccgacggccgcgacgaccggcgcacgcgtgcgctgatcgccgcaacgaccgtgcccgcgcgtcgtccatcgactccgccggcaccggcggtcggccggctccgaacgctgcgcaccgctgcacggcaggccggcgcacccgttcgggagcgcgtattgtacccgacggccttcgcgcgccgaggctcgtctacgcgagcacgacgggcgtatcggcgactgcggcggcgcgcgcatcgacgagacgcagcccttgcgccccgcgaatccgcgcgcgttccgacgcgtgtcggcggagcggcaactgcgcgcggcgacggtgcgcggcgtgctgtccgcgcgcatcgtgcgcattccgggcatctacgcagcgaaccgcctgccggtcgcacggctcgagcgcggcacgccggcactcgagccggccgacgacgtctacacgaaccacatccacgcggacgatctcgcggcgatcctgcgccgcgcggccgaacgcggcaagccggcgcgcgccgtgcacgcgtcggacgacagcgaactgcggatggggagtatttcgaccgggtcgcgcaggcgctgggcctgccgaggccgccacgcgtcagccgcgcggacgccgagcgtcagctcgagccgaccctgctgtcgttcatgcgcgagtcgcggcgcctgtccaacgcacggctcaaggccgaattgtgcgtgacgttgcggtatccgaccgtagacgatttccttcaaacgctcgcgccgggcagcgcgtcaggtcagcgccggtaatgcctcgatcagcaggaagcacaacagcgcgccgatcagcgcgccaatcaggttcggatgatatttgtgcttcaggtgcatcgcggccagcaggccgccgatcacgatgacaccgatgaccgcgaacgcgatcatcatgtacgacagttcgaaagtatggttgatgttcatgatgtctccctgcatcgctgctcgtacagcttgtcatttcagtatagcggggaacatgcggcagggatgcggccggacgtcgaacgatcgtgcggattttcccttacagggtttcgacggaattgcgcagcgctgaaaggtcggcgtcatcgagccagcgccacgcacccggtgcgagatcgcccggcagcgcgaagccgccgatgctttcgcgatgcagcgcttcgacgcgattgctcgccgccgcgaccatgcgcttgacctggtgatacttgccttcgaggacggtcagcgcgagcgcgtgcggtgcgcgcgcgtcggcggcgaccgccgcgatcggtttcggctcgccgtgcagctgcacgccggtgcgcagcgcattcagctgcgcatcgtcgagcggatggcgcacggtggccacgtaggtcttcggcaccttgcgcttcggcgacgtgtacgcgtgcacgaactggccgtcgtccgacagcagcagcaggcccgtcgtgtcctggtcgagacgtccgacgcactgcacgccgcgcgcgacgagcggcgcgggcagcaggctgaacacgctcgcgtggtgttgcggatcgcgcgaacactcgtagccggccggcttgttgagcgcgagatacgcgcgcgcgtggaacggccacgccgtatcgtcgaccgagaacacaaggccgtcggtatcgaacgcggcgtcggggtcggccgcgcgcgcccgccacgctgacgcggcccgcttcgatcaggccgcggcactggcggcgcgagccgaagccctgggtgtagagaatgctttcgagatccatagcgcgcgcattctatcaagcggcggcgcgcggccggcgtgaacccgcatgcgctggtaagctgccggtacgccgcgcgggtgcggcgcccgttcattcttcacggaaagtccatgcctttcgcttcgttcccgttcggccgcaaggctgccgccgtcatcctcgccgcaaccgtctcgtcggttgcgttcgcgcacgcgcatctcgcgaagagcgacccggcggcaagcgcagcagtggccgccgcaccggctgccgtcacgatcgacttcaccgagccgctggagccggcgttcagctcgatcgtcgtcgtcgacggcaacggcaagacggtgtcggacggccgtgcgcgcatcgacgcgtcgaaccgcaagcggatgacggtgccgctcacggcggtcggcacgggcgcctatacggtgaaatgggtggccgtcgcgaccgacgggcaccgcacgcagggcgcgtacggcttcagcgtgaagtgacgtgacgcaacggcggcggcaggcccgtgccagggctgccgtcgcttccattcgacagggagtcccgcatgaatccgacgacgctcgacgcactcgccgattttccccgtcagctcgaagctcatttcgcggccgtccccgacggctacgcgcgctggacgcccgacgactggaccggaatcccgagcgagcacttttcgccgctcggacagctctgccacgtgcgcgacatcgagaccgacggttatcacgtgcggctgcggcggatgctcgaggaagaccggccgctgctcgtgtcgatcgatggcgacgcgctcgcgatcgagcgccgctacaacgacgcgtatgcgtccgacgtgctcgcggcgatccgcgaagcacggcgcgagacgctggacctcgtggcgcgcctcacgcccgaacagctcgcacgcaccggggcgttcgacggttacggctcgctgaccgtgcgcgggctcgtccactacctgtgcagccacgaccagcagcatctggccggcatgcaatggctgctcggcaagatcgacgcggcgctgtacgcgcgctgagccggccggcatccgcggaatcgatccgtgattccggaaatcttgtcggtgcggcaggccacattaccttgcggcaattggatcgattttctggataatccatccagccacgaccggctgaccggtgcgtcgcgcgtgcctacactccaggattcgttcatcgagaaaaggagtccaccgtggcaattcatacgctcgcagacaaggtcgtcctgatcgcaggcggcgcaaagaatctcggcggcctgatcgcccgggatttggcgagccacggcgcgaaggcagtggcaattcactacaacagcgccgcatcgcaggcacaggccgaggagacggccgccgcggtgcgcgcggccggcgcggaggctgccacgttccagggcgacctgacgacggccgccgcggtcgagaagctgttcgacgacgcgaaacagcgcttcggcaagatcgacatcgcgatcaacacggtcggcaaggtgctgaagaagccgttcaccgagatcagcgaggccgagtacgacgacatgttcgcggtcaacagcaagtcggcgttcttcttcatcaaggaagcggggcggcacctcgaggatcacggcaaactcgtcacgctcgtgacgtcgctgctcggcgcgttcacgccgttctatgcggcgtacgaaggatcgaaggcgccggtcgagcatttcacgcgtgcggcgtcgaaggaatacggcgcgcgcgggatctcggtgacggccgtcgggccggggcccatggacacgccgttcttctatccggccgagggcgccgatgcggtcgcgtatcacaagacggcggccgcgctgtcgccgttcagcaagacgggcctgaccgacatcgaggacgtcgtgccgttcattcgccatctcgtcaccgacggctggtggatcacgggccagacgatcctgatcaacggcggctatacaaccaagtaatcgaccaagtaatcgttcgggcaacgcgccgcttcggcggacgtcgcggggtgcggcgtgcaccgcaatggcgcgtttgcgtggacaatggacgggcgcgcggcctcgcggctgcgcgcccgttttctgtgccgccggaccttgccgcgacgcgcgacatccggcggcgacgcgcttccgaacctacgctccctgccgatggacaagctggatcaggtcagaatcttcctgcaggttgccgagatgggcagcttcatcaaggccgcgcacgcgctcgacgtgccgcgcgcgaccgtgtcggcggcggtccagcagctcgagacggggctcggcacgcgcctcctgcatcgcacgacgcgccaggtgcagctgactgccgacggcgcgttgctgctcgaacgcggccggcgcctgctcgcggaagccgacgaactcgaccgcctgttccgccgccgcgaccgcgacgtgatcggccggctgaacgtcgacgtgccgagccggatcgcgcggcgcatggtggcgcccgcgctgccgtcgctgtttcgccgttacccgaagctgcaactgtcgctcggctcgacggatcggtcgatcgacctggtgcaggagggcgtcgactgcgcgatccgcgtcgggcggctcgcggacagcagtctcgtcgtgcggccgctcgggcagttcacgctgatcaactgcgcgagccccgactacctgcgcgaatgcggcgtgcccgagcatccggacgcgctcgcgcacggacactgggcgatcggctatgcgtcgccgacgaccgggcgtgaactcgactgggaatactgctcggacggccagcggtacaccctcacgctgccgagccgcgtgatcgtcaacaacgccgaaacctatatcgccagctgcatcgccgggatggggctgatccagattccgcgcttcgatgtcgagcatctgctcgacagcggagcgctggtcgaggtgatgccgggccatcgggccgcgccgatggacgtgtcggccgtgtatccgcaccggcgccatcgttcgcgccggctcaatgcattcgtcgagtggttcggcgagctgatggcgagcgcgctgacgagggcggggaggaccgggaggacgggagggcgactgaccggcgcgcggttcgcgtcgcgtgccgccgcgcggggttcagccgggcagcgccgcgaaccgccggctgcgcccggtatcccgcaccgcatcgatcaacgccgcccccgcgccgtccggttttgccgcgaacgcgtaaagcgtgcggccggcaacgccggcagaccgtcttgcggcccgcattcgcgcaagccgtcgcgcagctggctgcgcgccagcgcggtgaccgcgaagccggcgagcgcggcggacacgcagccggccatgctgccgctctcgaacagcacgcgaaacgggcgcagcgcggcggcgagtgccgcgacggcggcttcgcgataaacgcacggctgcggaaacagcgcgagcggcacctcaccttcggcgtcgagcgtgcgatccgacgcgaacgcccacacgagcggctcttcccacagcagttcgcccggcgtgtcgacctgccggcactgcttgccgaacacgacgtcgagccggccgagcgtctgctcgcgcagcagcgacgcggtgatgccgaccttcagttcgatcgacgtgcgcgggtggcggtcgcgaaacgtgcgcagcacgtgcggcagccacgcgcccgcgaaatcctccgacgcgccgacccgcagcggcccgtgcgccggcgcgccgcgcagcctcgcgcgcacttcgcgctccatgtcgacgatgttgcgcgcgtacgcgtacagcgtgtcgccggccggcgtgagcgcgatgcggcgcgtggtgcgcgcgagcagcaccgtgccggccgcctgttcgagccgcttgatgtggccgctgaccgccgacggcgtcaacgcaagccgttccgcggccggcgcgaacccgcggctgtcgacgacttcgaggaaggtgcgcagcagcgtgatgtcgagcgcggtcgacgcgggatcggtcagcggttccatggttcgattcaacacaatacgcgaagagtgaacaatgatactccgcgaatcgtgatgagcgaccggcctaccatcgtgcactcggatcgacccgacggagtacacgatgacgacctacgcgcatgcgacgaccgcgtcgctggatattgcctatctcgaatggaacccgcgcggcgagcgcgtggcggtactgctgcacggctggccggacagcccgatcggctgggacgccgtggcggcgacccttgccgcgcgcggctaccgcgtgctcgcgcccgcgctgcgcggctttgcgcccacgcgctttcgtgacgcatccgtgccgcgcagcggccagctcgcggcgctcggacgagatgtgctcgacttcgtcgatgcactcggtctcgagcggcccgtgctggtcgggcacgactggggcgcccgggcggccgcgaacgcgtgcgggctgcgcgatgacgccgcatcgcatctcgtgatgctgtcggtcggatacggcaccaacgatcccgggcagccgctgtcgctgcagcaggcgcgcaattactggtatcactggttcatggcgacgccgcgcggcgagcaggcgttgcgcgacgatcgccgcgcgtttgcccgtttgatgtgggacacgtggtcgccaccgggctggtatcgcgacggcgatttcgaggcggcggcagacgcgttcgacgggcccgactggatcgacgtcgtcctgcattcgtatcggcatcggtggggattcgtgccgggcacgccggcccatgccgatgacgacgcgcgcctgaatcccgcgccggtgctggcattgccgacgctggtgctgcacggcggcgcggatacctgcaatcacccggacagctcggccgggcgtgagcgcttcttcacgggccgctacgcgcggcaggtgctggacggtgtcggccactttccgcagcgcgaggcgccggcggcggttgcggaagcgatcctcgggttctgcgagccgcgctgatgcgcgccggcgcgcaccggatcaactgccgacgcgggcggccagcaggtcggcgaggccgatgttcctgaacatctcgcggcggacgcgatcgccgacgcggaacacttcctccgcgccgtcctgcgacggatcgacgaatacgcggtacgggcgcttgccggcgggtgcggcgacgatgtcggcaatcgccgtcgcgacggtgccggcatcggcgtctgccggttcgagcgcggcgaggccctgcagtgcctgcccggcgacgcccgcataggggccgtcgtcgtaggcggcctgcacggccgcatcggccggcttgcccgcgtgggcgaagtgattcgtgccctgggtgaaggcgcccggcacgacgatcgacgtctcgataccccagcgggcgagttcggcggcataggacaccgcgagcgaatccatcgcggccttcgcggcgaagtaaggagcgaggaacggcggcgtaccgccgcgtgcggacgacgacgacacccagacgagcaggccgcggccctgacggcgcaggtgcggcagcgccgcgcggttgacgcgctgggtcgacacgacgttgatgtcgtagagctgggcgatctgctcgggcgtgaacgcttcggccgcaccgaacaccatgtggccggcattgtggacgatgacgtccaggcggccgttgtccgcgatcacgcgatcgatggcggcaccgacggacgcgtcgtcgccgacgtcgagctcgacggtgcgcaggtcgaccccgtgctcctgcgcgtaggcggcaatggcggcgacgcgcggcgcgttgcggccggtgctttcgcgcatcgacgcgtagacggtatggccggcgcgggcgagcgcctgggccgtcagcaggccgaagccgctggacgcacccgtgacgagaatgacttccttcatgatcgatctccggtaagcgggggcgaggcaggcggcccgtcagcacatgccgccgttggcgcgcaggatctggccgttgatccacgcgccgtcggggccggcgaggaatgcgacgacgcgcgcgatgtcgtcgggctggccgagccgctcgagcgggttcagcttcgcgagccgatcgacgagttcggggctcttgccctgcaggaacaactcggtcgcgaccggccccggcgcgacggcattcacgcggacgccgcgcccgcgcatttcctgcgcgagcacctgcgtcaggctttcgactgccgccttgctggcgacgtacacgccgtaagtcggcatgcgcatgccgatcacgctggtcgacaggttgatgatgcgtccccgtcgcgcacccgcctggccgcttcgcggcatacgttgaacgtgcctttcacgttggtggcgatcgtttcgtcgaagagcgcatcgtcgcagtcggcgatggtcgccagcttcatcacgcccgcggaattgaccacgacatccacgccgccgaatgcagcttgcgcggcgtcgaacagcgcggccacggccgccgggtcggcgacgttcgcctgcaccgcgacggcatggccgccgtcggcgacgatcgcgtcgaccacttcgcgggccgggccggcgctcccggcatagttgacgatgacccggaagccgtcccgggcgagctggcgcgcgatttccgcgccgatgccgcgcgatgaacccgtgacgagggcgacctgttccgatgtgctcatgtcctgctccttggttcgtgagtgccgagcgatccggcgacaggactaatgtaggcttcctcggtcaataaaaataatgaataatgagaagatcaagaatgactaaaagtatgtcttatggcattcgacagcaggctttgagcgggatcggcgtgctctccgcggtgatcgaggccggcaccttcgcgcgggccggcgaagcgatgggattgacgcagccggcggtgagccgtgccgtcgcccggctggaagagcgcgtcggcatccggatcttcaaccgcacggcgcgcgcgatcacgctgaccgacgagggcggcgtttctatgaggcggtcgcgccgctgctggccggcatcgaggaggcggcgatcgacgccggccagtcgaaggcgcgtgttaggggcggctgcgcgtcaatgtcgacgcgaccttcggccactacgtgctggcgccgaagatggccgagtttctcgaccgcttccccgacctgtccgtcgagatcagcgtgcgcgaccggatgggcgacctcgtcgccgacgggttcgacgtggccgtgcgattcggcattccggaaccatcgtcgtatcgtgcgcggctgctgctggaaacgcgcgtgctcacctgcgcgtcgacggcctatgtcgcgcgtcatggcgaaccgcggcatccgcgcgacctcgcggacgggcaccgttgcgtgctgatccgcgacccggtgacggggcggccgttcgaatgggaattccatcgcggcaaggaagtggtgccgttcgatgccgccggccggctgatggtcaacgatacgggcatgctgctcggtgcgtgcctgggcggcgcggggattgcgcaattgctggaactctatgcgcgggacatcctggctgaagggcggctggtgctgctgttgccggaatgggcggacgagacgtttccgctttacgcgtatcaccacgcgtcaaacctcgtctcggcgaaggtgagggtgtttctcgacttcgttcgcgaactgatggcctgagcgcgagacgcggccggcggcaggacggccggcgcttcattcggtgcgatgcgggatgttgtccgggaacggatacggtgcgtgcgggcccggccagtcaggcaccggcggcgcggtcaggacgtcgcatccacccagcacgagcacgagcgccacggcgagcacgcggcggcggagcggggatgaaatcgtgcgcatggacatggcgtgcctccgtgccgcgcatcctcatgatgcttcgactgttgcgcgggggcgcgcgttgcggcgcgtgcggcaaaacaaaaacccgcgaagcggcgagcttgcgcgggtttcgacagatgcagcgcgtgacgctgcgaaatactggtgccagggccggaatgaaataattctatgtgagtcctgtagtgtaagggtgttgcctgtggagtgttgctgagttgccccagagttgcccccgcgcttctggcagccgcagaattcatatcgctccgctgcgtgtgccgttcgggcgaggtcgttcaggagataccaacaggcgtatcggcgtaggctcgatcagtcgaaggccggtgccgtgcggaacgttgctgtgccgccggaagcaaaaatatttggagatttggagatggacggttgtatcggcctgtaagccttgtctggtaaggctgtggttatctcaagtctatctccaaagtacacattttcttggagataaagttggagacagactgctgagctatggcgtccgcacgacgacgttgagagctgccctgccttctggaacgctgcgcgcaaagaacgccccgcgcggccacaccccgagccggcgttacgctagaaagttactttgcaaccgtcgcatcacgtcagtgattggcacgagcaagcgcggcataatcgcgacaagattggtgattcggggctgagatgtgcaagtccagacctgatctctcagtcggaggcatatcaggtctgagattgtctagacgtcacctcatcaagggccgtgatcgacccgaagcggccagccgtggtttcctaaaacggccgttcacggccgcacatccaaccgatgactgcgtgttcctcgacaacaagtgctaggaagcatgagcctgcaccagcacgtcccaggggcgggagacggaaagatgtcctgcaaaaatccgacaaacgctttcaccgccggattgctgcggcggctttcgggccacaccgcatgtaaatggaatcggtcataggcgaactcatgcagcacaggcacgagttcgcgccgtcgaacgaatggtgccgcgatatacgtcgtcgaaatcccgataccggcgccggccgccaacgtcgcggcaatcgcgtcgctgacgtcgataatcaaacccgacgcaggcgtgaactcgacgagcttgcctcccacgtcgaatggccacgcagactcctgccccgttgactgatatctgaagttcacgcaatcgtgttgcaagagatcgttgggatgctgcggtacgcctcggtcccgcagatatcccggagacgcgaatgcgcaaatccgatgcggtgcgagacggcgcgcgatcaaccgcgtgtcgccgggatcgccgacgcgaatggcgacatccacgccttcctcgatcaggtcgacgtatcgatcgctcaggcgcacgtcgacggtcactttcggatgctgccggcgaaacgcgggcaaggcgggcgcaaggatgttcacgcccacgggcagtggtgccgtcaccttgagcgttccggccggctccgcgcgcgcggcggcgacgccttgctcgataccttccgcctcccgcaacaagcgttgcgtgcgctccagaaggtcgcgcccctccggcgtcagcgtcagcgagcgcgtggtccggctgaacagtctgagtccgaaatgctgttccagtcgctggatgctcttgctgatagccgatggcgaaacggacagagagcgcgcggcagccgtatagctgccaagcgacgcggcacgcgcgaaggcaatcagcccagttaatcgctcgacaatgatttgttccatgatggcatcattaaagcgaacgacggcctgattatcaagccctgattcgcgaattaaccttcttccatcgacgccacaccggcgaagtcaaacaggagaaggaaatgaacacgaatacgaaagcgcaggacgcgcaggccgcggaagtcgccaacggcgcactggcgggcaagaccgcactcatcgtcggcggaacgtcgggcattggcctcgaagcggctcttcaggcgaagcgcgcgggcgcggaggtcatcgtcgtgggccgctcggcagatacggctcaacgcgtcgccgcgcaacatggcttcaccggatggcgcgcagccgacgtaaccgacgcccacgcgctgcaacaggcggtaagcgacattccgaaggtcgatcatctggtcttgctggccggcaccttcgtcgcggggacggtgcgcgaggcggacgtggcgcatctccggaacgcgttcgaggaacgcatctgggcggccgtgcatgccattcgcgcgctgggcgaccgcttgagcgccgatggctcgatcacgtttatctcgggagtctcgccgaccgtccgaacgcctacggcaccgcggtgctcggtgcggcgtcggccgcgatggaagcgctcgcgcgcggcctcgcgctcgaactcgcgccggtgcgcgtcaacacgctgtcgcccggtccgatcgacacgccgatcctgcgcaaggcgctcggcgacgcgcgcgatgcggtcgtcgcgaacatggagaagacgctgccactgcatcgtctgggaaccgccagcgaagccggcgcgggcgtggtgttcctgatgaccaatggcttcatgaacggcacgacgctcaacatcgatggcggcgcgcgcctcgtgtaacgcccaagccaacggagaaagacatgaccacgctttttgaccccatccggctcggcgacatcgaagcgcccaaccgtatcttcatggcgccgatgacgcgcgcgcgaggtacgcgggatcacctgccgaccgcgatcatggcgcagtactacgtccagcgcgcgagcgcgggacttattatcagcgaggcgattggcatctcgcagcaaggcctgggatggcccttcgccacgggcctctggtccgacgaacaggttgcgggctggctgcgcgtcaccgacgccgtgcacgcagccggcgggcgcatcatcgcgcagctgtggcacatggggcgcaccgtgcatcccagcttcaatggcgggatgcagccgttatcggcgtcgggcacgactgcgccgggctacgcgcatacctataacggcaagcaaccgtacgtcgcaggcagacccatgcgcgcggacgaagtgcctgcgctcctcgacgattttcgccgcgcgacgcgaaatgcactgcgcgcgggattcgatggcgtacaggtgcatgccgccaacggctatctgatcgacgagttcctgcgtgatggcaccaactctcgcgacgacgcttacgggggcagcattgaaaatcgcgtccggctgctaaaggaagtcacgcaggctgtgatcgaaatagccggcacgggccgaaccggagtgcgccttacgcccaacggcacggaccaaggtgtgcgcgacagcgatccggaacccgtgttcgtcgcggcggcgcggacgctatcggcgctcgacgtcgcgcatcttgaactacgcgaaccgccgatgaacgggactttcggcgcatccgatcggccgcccttcgcgccagccatcaggaaggcattcgcgggcgtgaccatcctaaattccgattacggtctcgatcgcgcggcagccgctatctccggcaatgaggcggacgccatcgccttcggccgaccgttcatcgcaaatcctgatttgccgcagcgtttcagcgcgggcgcttcgttggcggccgataacggggtgttgtggttcacgcaggggcccgaaggctatctcgactaccccgctcttgcctgagaagattaaggtccgctgctgggcggcttcaggcgcatccggcggcagttaacttaacgaacaacggccattcagggagggcgggcgaggcttccggtagccaaactggacgacgaccgcggccagccgctcatggccgaccaccctgccacggacggccggcggaggtcgacccttagccgccgctcgcacttgtccgactgcaacggccgtttctggagtgctgccgccgcatccgcgcctcgccgagcacttacttccacagtgcgctcgaagaccacgctctgacccagcccgtggcggacatcggtttcgacagcgaattcaccgacgcttaaccgatggtcggcggcgcttgacgcaaaggccggtattcgtggttgggcgaggcgtagtcgatgtactgatcagccgcgttggtcatccgtagcagtaggcgctggaacagcccctcagcagcttcatgtcccggatcgcagccacctcctgaccctgtgggatcggcgtgccatgggcggctttgttccgtcggcgccacgcggcgtcctcgtcatcgcccagctcaaggttcaaggcagccatcacgtctttcagccgctgacgctgatcgatgccattgaaggtaggcagcttattcttcaaggtcatcttcgcctcaagggagatgttgccgccgtcgatgacggcgctgagtgcagtcttgaggatcttccattcgtctcgggtggcccagccctcttgcacctttccggggttggctttggtgtaggcactctgcaagccctcgatcgccgcgccgaagtgagcgggcgcgatgtgcggagtggcggcgcacgcatgccagaaggcccagtgcaggttcgcaagatctagggagtcgaacgccgtcacaaatgcctggatcgcctttgacagttgtggggcaccaagctcattcaggaagcggtcgccgagcggcgcgagctggagagtttcaatgtcgaaggcatggcggcgcaggctgtaggcgctccgtgcgagcgtggacacgacgttccattcggcatcgtagtgggatgtgccgagatcgaccaagtacacgcccatcgcgaaagaaaggcctgttcggaccttctttcgaaactggtcgtctggggcgccatcgtagacgatgcaccccggcttgatggcgccggggcggtcttctctgtcgagcgcgcaaacgtagaaggtcgcgccatccaccgtaaccttggcggagttccacgaggtgctggaacggtcggtatcgctcgcgatagtgatgccgtcgttcagagaaattcttcgagtggtgatggttctggtaaccacgttggaagccgctggccaaacgtatgggctcgtgggcaggttttcgagccagtcgatgacatatgccgcgggtgccccggacgggttgtttgtcttggcgacatggacctgagccagctccttgaggggctgctcggtcacaccgagggtctggcgattctgactgtagggcatcagcccaaagaattccccttcgagaccacccacgctccggaggagcgcccgctcgttcgtcaaacgaaccgtgcctggcggcagattgatcgccgccgacgtcgcattggggcggcctcagtctccaagataaggttcagcttttcgtcccggcggatcgaaaagctacgaattggctgatggagtgggccgggatcggtgatctcgaaaaagcccttgttcaggattcgaaggcattcctcggtcaggtcgcgcatcatcagaagagccgccggatgtccgttatcggccgaaatagctttatgggctgatcgggcaatgcgaggagactctcccgctcataaaagcgacgagcgccctcatctttcgcgtcgatgataacagcgaacgacgcaatttcactccgtgcggcgcggtggagcgcaagcgatcgctggggaccgtggctagggtgattgcggcgcacgcgtcttgaatgaaggagtgaatacgttcacgggacagcatggcgggcaggtcttgccggtgaagcggtcactggacaggctacttgagcgatcgcgcaaaagactcatattggccgaactgagccagacaacctgactctgtctgcttggtccggtgagccgggctctagcagggcgtgagttgaacggcgcgcgcagcttagactgcgtcgcgtacccgcatgatcgtctggcggctcgtgccaaatcgccgagcaagcgcggccacgcttgcccccgcgtccaactcgcgcagcacgtccgcccgctgctcgcccgacaggacggacggccgccccatcgccttgccttccgccttcgcgcgagcgataccagcgtgtgtgcgctcaatcaacagatcccgctcgaattcggccaccgcgttcaacacctgcatcgtcatacggccggccgcgctcgttagatctacgccgcccagggcgagacaatgaacccggataccgcgttcggccaatccctcgaccgtggcccgcacgtccatcgcattgcggccgagtcggtcgagcttcgtcacgatcaacacgtcgccttcttccatcttgacgagcaactgcgcaaaccccggccgctgatcggcgcttacgctcccgaaatgctttccgacacaacgcggcgcttgtcgaccgagaagccggccgcctcgatctctcgtaactggttcgcggtggtctggtcggacgtactgacgcgggcataggcaaaggttcgggacatatcgggcactcaatctgtacgaaatagatgtccgaatgtaaggcaacgtccaaaacatttcaacccttatttacggacagggcaaaatgcccctgtccgtaagggatcggttttggacaggtgcatttgattggaggccgattgccttctggtcggtcgccttctccgttggtcggccccggcatacgttttacacagccgcggccgaatgcggccggccgccgccctgtgacgcacgaccggcgcagagcgacccacttcggcccttcgtcatcgttcgaaactcaacggcagttcgcaaggtccactagatgtccacgcaactaaagtagcgcggtcaatgcacggtcatcgcagccgtcgattcgacatgcccctgtaaatctaggctgcgatggccgtgcatcgtcgaccaactgacgagcatcccgaaaacgcaaacgagaatcaatgaagtttaagtctgcagatgttcactttaatagaaacagcgtatattattcagctatctcgaatcctaccgcatgcagcgcaatcatatatatggcgattcctgaggggttaaaaactcgatctccacattgcctccagcaaaatttgtttcaaagtggatttttgagtcggttccgcatgtatttgggggtgatctggataaatatattgcatggaagcatgtgcttggtgatttgatttccgttgacccgcgagccataacattggtcggaactgcctctattggtattagctttaatccgaacaaaaactttaagccttttgatgagaaatctgacattgatgttgcgatagtttcccatcatcattttgatatagtgtggaggtggatgagaacccttggaacggcatatctttcacttccggctcaagcacaaacggctatcgatgatcatcggaagcggtacttatttaagggcgtaatagcaaccgaccgaatattggcacatacgccactggcgtcaaaatgggtccctgcgctatcaagtatggcggggatggacccaacagaggggcgtgagattaatgcgcgattatatgccgactatgatgcgttacgagcttatcacgttgatggtgtcagaaatttaacaagaaaaattttagaggaaaagtaaagtgcaggattatcttaattccactaggcgtagcatttccgccttcaagaaggcggctgacgataatcggcttaaattgaaaccagcctttcagcgaaaccctgtttggaccgatgctcaaaagtcctatctgatcgattcgatattgaggggatatccgattcctgagctttacgtgcaagaaagtactgatgcaaaagggaatgaggtatttaccattgttgatgggcaacaacgtattagggcatgccttgaatttttggaaggaagtctaagcctgacgccggacgaagctcctgattgggcggattttacgtttgatgacctatcggatacggataagcaaaagttgtgggggtacaattttatagtccgccaacttccagacgtcggcgacaatgagctaagggcgatatttcgtcgcctaaatcgtaacgttgttgcattaaatcagcaagaacttcggcatgcaacatattggggaaattcattaattgcgttgaaaaattagtgactacgaccaatggtctgaaatcggcatatttacggcaaacgatattcgtcgaatgattgatgttgagtatattagcgagttggtgattgcctacttgcacggattgcaaaacaagaaaagtcaattggataaatggtatgccacgtatgagaaaagttttccagaccaggctaaggtcgagtcttgctttcacgatgtattgggcgaattggggcaaattttgccaaatatcaacaagacgcgttggcgaaagaagtctgacttttatacgctatttttgatattcgcaaatcacaggtcatcactgccacttaccaaaacgaagcgtgcgcaagcggctaaaaattaatcgcctttggagaggaaattgattcattcatatccacaaaggcgcaggcgtcggctgccgctaagagctatacaggtgcggtcgaacgtgccgcttccgatctggcaaatagacagcagcgtcagcagcaactagagaaagtgttatcgggaatttttaaattcctggttccacggtatcttgtttttcgggcgctgtacttacagcataagaaacatctgctatagatcaaccttgggtgcgaaagcctgcggatgtgtgtgatcggttgtagtgctatttgcgttgtcattgatcgcgcgtccggttggccagcgaaacggactgtcatatttaaaatggacgccgggagagaatgacggctaatggccgaacgcggccggccaccgccctctgacgcacgaccggcgcagatcgcccctgagctgcctttcgacatcgatggcgcgatgttcggtatatagcccaaagcagtcatcctacacaagtcgtcgactcgaaagtgccgggcaatattggcgatcagcggggcagataacgcggataagaaaccgccccaacgccattggttcgaagaataaattagttatctcgctgttggcgttggacacttcccttcgattcagcgcgttgcctctagcgctcgctgggcgaagaggtacaaacgcaaagccccaggttcgccgttacgaagtgctcgacttcattcgtgtttgcgcccttcggatgcgaaaactccaccaagaggccaatacgttcgagcttagtcgcaaatgggccgacatcgtaaaatagatttatcggtgtgtcgccgtttgagaagactcctctcgtcaacgacgatctgactctagccacagcggtagcgctctggattatcggtatggttggcaatggtggcctcggattgcgcttgctctcggacgcgaccgagaaccattccacaaaatcgacaaaatcgcgatcatgcaacgattccgatgccaagaatagttgctcgtcttcggttgtcgcttgttgatccttaagcaacagccccgcagtaagtaaggcgataatcttcggccccacgtcccgactcgcacacaacgcgacacgtcggtaggaatcgtacagcaatgcgctctgagattctccctcaacgagcctttcaagtacgtcgttcagatccgctgaaaggcctttgatctcttgctcttttctcacctcttcgaccagtcgctccgtgaatttctgtgctcggtactcaccccaccggccgagaaccttctgtttgatttttctttgaaatgctcgacgactgcctcaccagcctttgatgcgagccaatgactcgcttttccgatcacaatttcgataggcatctttgtttccactagatcaattttagcggcttccggaaagccgggatgggctagagcactagattatcttccctttgggagtggctccatttggagcaacaacgccattgcgtcttgtcgctccgcggaatacccgagcacatcggagatcgcgaccccagtaagcaggccgctctttagcgcgaggtgcagcgtagcgatgttgtcatctacggttgattcacctaatgcgatcgtgaaaccaggttttgtacggttgacatagtgttccaaagagcgacccgtcacgtgagccgagtcatccgaaagacgctggtagtccagatacaagctgaccagtggaccgagttcggcgacgcgttttgggctgatcagttggagtcttttatccatcgcgtcgacgacgcgctgcaatctttcacggttcaaatcgacgtttccaagccgcctgtcgagtatgaattgtccttggttgcgtctgcttttatcggagtcattcttcagcatcatcagaaattcgtccggttttgtcgtgagggcagcagccgcgaacgtgcattcgagcaggccacgcactagcatccgcgcagcccgcagagttcccaggctagtcaggttaagcgtcgccccgaacagttcatttgaccgcaaagcaactcgcgccgcgacggccttcgcagaccaaaggctcgtgccggaaggcagatcaaagcaccggttaccaatcgtatccaaaacatctgcggcgtcggtggctaaggcccgccacgcttccaaagtctcgtcagagttagctgattcaggtccatagtccatgtttcgatccggcggtgagacgaaggagagtccgtctcgccaatgttaacctcgtccaagatgccagcgctttgcacgaaaccaattcaggttcgactcatctccgatatttgcgacgccaattgatgcggcgtccgctgtgagagcaaaaatgagcgttcaaacacaatcgacgaaggtccagacgtggctgaacagtgacactatgtattgcgcttttagataatccgagacaagtcttttatgggggcagacctttcgatataattgcggtacttgttggcacctaatcgaacacggctctatgaatctgtgggcgatgcaagggaaaaaggcggggacgctcagtcgttgagcatatttcgtcgcgctgacgagagggtgccggggtgtgctaccaacacatcccaccggcgatttttggcttggctgcctgttccataattggaggaactacaagagccaccgcgcctaggaaacgcatagctcttgttaggacgaatgataccgcgcgcggcgcgccgtgcaaagtaactttgcaaagttactttgcgcgtctccctgaacttcattgcgcccgtactttgatagtacggcgtggtttattgccgccgctttcctccttcttgcggaacaggccatttctgaacagaaaatggctcttaagattcttcgacttattggtgtgctggattgcgtcggcgtcaagaaaacgacgctgtatcgctggattcgtgaaggcaagtttccagcgccggtccagttaggggccaggagcgtcggctggcgcgcgcaagacgtccagaactgggtcgaatcccgccaatcgacgcgggagcaagcatgagcgcgccctcccttatgatcgatcgcggcggcccgtatggtcgggcgatgggcgcggccgtcacggcgcgcgacgccgcgttcgtgcgttgccgcgatgtccgactccgcaagctcgcaggaatcctcgatgacatcgagggttgcttctggaaccgtggcgacgacgccgggaagctcgttgcgatcgccgtcacgcttgcctcgacgctcgcgctcgaagccccgcgtctgacgacaaagcaacttggcaccgcctgcgagaagttcgtccatgcgatcgccgctgctgaacaggattcggcgaactatcgtcgtcgacagtaccgacagctgcggaaagcctatcgtgcgctttacaacgacatcgatgcgcagtgcacggacgggacgcgccgcttggaagctagcgccctgctgcggggcgtcgcgctcggccaatcactggcgcagggcagctcgcgactggatatcgaacagctaaagctggcgactgccgtactcaaggggaggccgtctgatgctcgcccaaagtcgctttgcacaagcaatacacggcgaggggcgtcgcgatttgcgtcgcccagcatcgcgcggtatcctgtgtgcgtcgctgagacaacagcgaccgggatttgcagcccgacagttccaaggcggacgaccgccgcagtgcggtttttacgtccgtgtgccttcgcgcgcctctacgatcaatgggtgggcgacggtggggaggcttcggcctgccggttcccttggacgccggtctgcaaaccctgccgtctgcccgcccaccccaatttgcagtggggagcgggttcaacccgtccaaggaggtcgcattcaatgcgccagtccacgcacgcccgtaccgggcagcaatctcacctcattcaatccatcgtccgcacagcattgcgcgacgcggcaaccgccagcacttatcaagacgcgctcgacgcaaccggcgcagcactggccgcgatcgccgcgctcgtccgtgcggaggtgcgtcatggctgagctgcgctgcaagatcggcgatctggcgatcgtcacgaaatgcgatgcacgctcacgcatcggcatgctggttgaggtggcatcggctcgtccgacgcccgatcacgattggcgcgtgcggatcttgggcggccccgtctcggggcgtagcgtctgcggtcgccggtccggcgatttcgcgcacgcggccgtctttgactggaacctcacgccgattcgcggcgaagcggagctggattgcacgatcgacgtcggacaactcctcgcgtcgattctggaggtgcgccatgtctaaataccgcctgccgaacgaagtcacgatgatcgccatgtgtgcggcccatcagttcgcccagctcgaagccctgttcgatgccgtgcgttcgcatcttcccgagggcacctacgagcgctcgcttgtcgacatggggcagggcgttgcgagccggtattccgccgaaatgcgccgtaccgctcaaccggaggcgtgccatgactgaccaacgcatccggaccgcggttgtcaatggcttcgacaacgcaccgcccctcgataccggcgctccgatcgagctgcaattcgccgtcgacctgggcgcgatctgcgccgaagcatggctcgacctgaaaggcgacgtgcggctgcacgactacgcggcacatcaagccgccgcgttcgcgcgcggcatggaagccgccatgcaggacgcaggcgacgtcgacgcgcaccgcgtgacgatcagccggcaagcgttcgcagccggtctgatggggcgcgtgcagcagcacctgttcgcggcgctcggcctcgtcacgcgcgaaccgcgcacgacgcactgaggggcggtcatggcaaagacgaacaagaacgccgtgcaatcgctcgcttcgcacttcgtggccgaggtgaaccgtcctgaccgcaactgcatcggcacgcggatcagtgacgccatggagctgctggacagcctgcattgggcggccgacaaggcaatgtccgatgacgactactggcttgtgctgagcctgttccgtgcgtccctgccgtcgataggcgcggcgctggaggcggcgaacgacgccctcggcgagtcgcggctcggccgctacgtctacagcaacgacgttacggccggcggggccgttctatcggtgcctcgcgcggccggctgacgctccgccgctaggcatcgtcacaccattcaattcttcgcgcgtcgggtagctgcttgcccgatatggactactaatcggaagccgaccgacgcgcgtccagtgggaacctatgagtaacgcacccatgtccgaattcgagcgggcgagagtcgcgctcggctatgttccgcccgacgaccgcgacacgtggagtcaggtggggatggcgctcaaggccgagtttggcgaggagggcttcgccctctggaacgaatggagccaaggcgcacagaactacaacggcaaggacacgcgcgatgtgtggaagtcgttcaagggcggcaagatcaccatcaacacgctgtttcacctcgccaagcttggcggcttcgatccgcgtgcgcatcgagccaagcccatcgatccagcggagcgcgagcggcagaaggccgagcgtgcggcacgcgaagcggccgagctggccgaactgaccgagaaacagcaagccgcgtcggcgctcgccgaatcgatctggtcggcggccgagcccgcgccggccgatcacccgtatctcgttcgcaagcgcatcccggtcgacgcgctgcgcgtctatcgcggcggcttgtgtatcggcacggccgcgtgcgacggcgcactcgtcatcccggcccgtgacgcggacgggaagctgtggacgctcgagttcgtcctcacggacggccagaaacgctatctgccgaacggccgcaaggcgggctgcttctcgttgatcggtggccagttatcttccgcgccgtccacgctgctgattggcgagggttacgcgacgtgcgcgacgctcgcggccgcgaccggctatccggccgctgtcgcgttcgacgccggcaacctgcacgcggtcgcaacggccctgcgcggccagtatccggacgcccgcatcgtcgtttgcgccgacgacgaccacacgacgaagggcaatccgggcgtgacgaaggcgcgcgcggcggccgatgccgtcgccggcatcgccgccgtgcccgacttcggttcgaaccgcccggcgaacgggaccgacttcaacgacctggctgcgcacgtcggcccggatgcggtggccgccgccgtgcgggctgcgctcgcgccggccggctcggcggatgcgggcaagcccaaggtcgcgccagccgccgcgaagcccgccaagcgcccgaaaacggctcgcgcgcaggacggcaagtcgcgattcgtcgtcgacgacaagggcgtgtggtttcacggcttcaacaatcagggcgatccgctcccgccgcattgggtcagcacgcggatcgacgtgattgcggagacgcgcaacgagatgaacagcgagtggggctacctgctcgaattcacggaccgcgacggcatcctcaaacggtgggcggtgccggcggggcttttgccggcgacggtacggagctgcgccgcatgctgctcgatatgggcgtgaagcttggcgtgacgcagatcgcccgcacgcagatcgcgaactatgtgcagatggcgcagccggacgagcgcgtgcgctgcgtgccgcgcgtcggctggcatcacggcgcgttcgtgctgcccgatcgcgtgattggcaccggcaaggaggcgctgatctatcaggccgacacgccgatccagagccagttcaaagagcgcggcacgctggacgactggcaacgcgaggtcgcggcctactgcgtcggcaatagccggctgctgttctgcgtcgctaccgccttcgctggtccgctgctgcacttctccggccttcagtcgggcggcttccacctgctcggcacgacgtcgaaaggcaagtcgacgggcggcgtcatcgccgcgtccgtgttcggctcgccggactacgtgcggagctggaaggcgaccgacaacgccctcgaagcggtcgccacgcagcatagcgacgcgctgctgatcctggatgaaatcggacaggtcgagccgcgcctggtcggcgatgtgatttacatgctcgcgaacgagtcgggcaaggctcgcgcgtcgcgtagcggctcggccaaacccgtgctcacgtggcggctgctgttcctgtcgaacggcgaaaagagcgtgtccgcgctgatggccgagggtaacaagcccatgaaaggcggtatcgaggtgcgcttgcccgcgatcccggccgaggtcggcgaaatgggcgttgtggagaaactgcacggcttcccgacgccggccgcgctgatcgagcatcttgagcggcacgccggccggcattacggcactgccggtcccgcgttcatcgaatgggcgtcgtcgcaggccgacgagctggccgagcatctgcgcatgcgcgtcgacgagctggtcgggcaatgggtgccggacggttcgcattcgcaagtcgcgcgcgtcgccaagcggttctgcctcgttgcggtggccggcgagctggcgacggcgcacgggctgaccggctggccgcagggcgaatcggtcgaggccgcacgtcgctgcttcgaaggctggctggaactgcgcggcggcaccggtaattcggacgaagcggatgcggtgcgacaggtgctgcacttcctcgtcgcacacggcgacaaccgtttcgtgtggatgaaccgggcgcaggacgaccatcgaccgaacgcgccgcaccgtgcgggctggaaacgactcgtgaaacacgacaagagcagcatcgccatcgagtcggatcaagcgtattacgctgagttcggcgagaagatgagcgccgaagacgcggaaagcgtcgagacggaatacctgatcgagtcaaccgtgtttcgcaaggaagtatgcgccggctacgaccataggatcgtcgagaaggctttgatgaagcggggtgtgctgatgttgcgtagcgatgggcgtccgtatcgacaagaacatatccccggcatgacaaagaaactcatggtctatcgcgtcctgccgtccatcttctcactcgaaatctaagctgcaccgccgccgtccgggagggcggtggcgggcatccctttgcgcggcacttttggcccgtgcgtcaaagttactttgagcgatacgctccagatggatccgggtcggcggttgcctcgactcttgctgatgatgtaacaatccagcccggtttatctccagtatctccagcgttctccaaatcgtttggagacacacgaagccttaccctacaaggctttgcggccgattctggcgtttatctccaactctccaactcgttttgcactgaccggacaggcgtcgaccgtctgcttctaccgcgaagctagacggggcgcggctctccgggattcgacgggcatcagaagcgcgttttcgagggggtccgagatacgccccgattgggcattgttgcgccgactgcaagtgtccgggcggccggaaagcggggaccctgcgtctagggcaaagacgcgggggctcacacccgcgtcttttctctactgacggcaaacatagggggcacataataataagggccaaatcatcgcctcaccctatgcctaggccgtgtccgttttactggtgggagacgcacggaaggggtcatactcgtagcggtacgggtctatcttgccgccgcgatcggaatgatttccgccccggctttgagcttgtcgaggtagtccgcccactgttgcatcatcgagcggcgtgccttgatgaactttgttcggttgtacgcccgcccaaggctgtcagggaccgtatgcgctagttggtgctcgatcacttccggcttttcctccaactcttcatgcaggatcgtccgtgccattgcccggaagccgtgaccggtaatctcggtgcgagtgtcgtagccgagccgacgaagggctgcattgatagcggcctcgctcatcggccgatttcggtcgcgagcaccggggaacacatagacgccttcgccagtcagggcgtgaagctcgcgcaaaatcgtgacagcctgcgcggccagcggaacaaggtgatccgttttcgttttgttgacgaaatagcgccattcgcctttgtcgaggtcgaattgcgcccattctgccttccgcaactcgcccggcctaacgaacagcatgggggctagcttgagcgcgcagagaaccgggaacgtgcctgtgaagccgtcgaacgcgcgaagcatctcgcccactttctccggctcagtgattgaggcaaagtgtgttgtctgcgcgggcgggattgcatctaccagatcgcgggccggatcggccttgcagtgccctctttgatgccgtagcggaatacccggctaatctcgctgcggatgcgatgggcggtaaatctggctccacgcccgtctacgcgcttcagcacggccagtatctccggggcgtcgatttcagcgatagggcgcttgccgagccatgggaatacatcgttctccatgcgggcgagcgtcttggcatgctgcgctggctccacggtcgtcttgcgctcggccatccagccacgggcgacaacctcaaacgaatgggcggccgcgagcaggctggccctttttccgccttcttcgcttcacctggatcgatgccggcagcgagcttttcacgggcttcgtcgcgcttcttccgtgcggtcgccaatgtaacttccgggtagacgccgagcgagtagcgcttttccttgcccccaaatcggtatttgaggcgccaccacttgcccccgctcggggcgacttccagatagaggccgcctccgtcgaacaggcgcacgggcttgtcggctggcttggcgttccggatggctgtatcggttaatggcacggggcaactcctgacgggtaaggcaacttcggatcggttgcccccaatgttgcccccgcttgcccccggctgtctacgcactacacggcactttgccggaatgaaaaacccgcgaagccttgtgctgtcgcgggttttgggacttccgggaatttcccggaactatgtcatggtgcccagggccggaatcgaaccggcacgccttgcggcggggattttgagtcccctgcgtctaccaatttcaccacctgggcttgatcctggccgcgcatgcgattgtgcgcggcgaaacgcggattatgtctgaaatcccgacgccgggcaagctgccccggtgccggtcgtgcacgtcactggctcaggtagacgaaccggccctgcttgacgatccccatcacgctcgcgcgctgatcgagccccacatgatccttgtcgctggtattgacgacgccgttcggcacgacgagctcgtgcgcgcgttccagttcgcgccgcagcgccgcacggaacgcgggcgtgccgggctgagcggccttcagcgcgcggccgaccgcatcggcaaggcgcgggtacacgcccgccgcgtcgcccgcgaactgcgtgaccgtgccggcgccgtatttcgcctcgtacgcgtcgacgaacgcgagcgctgccttgcgggccggatgatcggccggcagcgtgcgcgcgacgaccaccggctgggtcgggaacagcgtcccgtcgacgtccttgccgccgagcttgatgaattccggcgtcgcgatcccgtgcgtctggtagaccgggcccttgtagccgcgctcgatcagcgtgcgctgcggcagcacggccggcgtgcccgagcccgcgatcaggatcgcgtcgggtttcgccgcgatcagcttcaatgcctggcccgtgacgctcgcgtcggtgcggttgtagcgctcggtcgcgacgacgcggatcttgcgcaggtccgcgaagcgcgtgaactcgttgagccagctgtcgccgtagctgtccgcgaagccgatgaaaccgaccgtcttcacgccgtggttggccatgtagcgcgtcatcacgtcggccatcgcgcggtcgctctgcgccatcttgaacgcccaggtccgcgcgccttcctgcggctcgacgatcgcgccggagccgaccagcgtgatcatcggcgtctgcccggccgcgaccgcgtcgagcgccgcgagcgcggccggcgtgatgttcggcccgaccacgacgtcgacgtgatcctcgtcgaccagcttgcggatgttgcgcaccgcggtgcccgggtcggatgcatcgtcgagcaccgtcacctgcacgggctgcccggcgatcgtcttcggccacatcaggatggcgttcttgctcgtgatgccgatcgcggcggccgggccggtcgacgacaggtcgacgccgaccttcaggtcggcatgggcggcggcacaggcgagcgcgagcgcgccggcggcggcgcggcgcaacagggcgggaagcgtcatgcgggattctccgtcgggcaacgaaaggggcgcggttcagattcgcgcccctgtgtttatacaggccggtcaaagctcgtacgattcggattcgcccttgagcgcctgttcgatcagcttgcggttcagcgtcggcgacagcagttcgacgagcgtacacatagctgcgcaggtaggcgccctgcttgagcgcgacacgcgtcacgttgctgccgaacaggtggccgaccgggatcagccgcaggttgcggtcgcgctcgggattgaacgcgatgtcggccatgatcccgacgcccaggccgagctcgacgtaggtcttgatcacgtcggcgtcgatcgcctcgagcacgatgtccggcgacagcccgcgcagcgcgaacgcatggttgatcttcttgcggcccgcgaacgcgtcgtcgtacgtgatcagcgggtactgggcgagatcgtcgagcgtgaccggcttgcgttcgagcaacgggtggtcggccggcacgacggccgcgtgatgccactggaagcagggcagcgacacgagttctttgtagtcggagatcgcctcggtcgcgatcgcgagatcggcctggtcgtggatcaccatctcggccacctgcgtcgggctgccttgcaggatcgacaggtgcaccttcggaaagcgcttcttgaattcggcgatcgcggccggcagcgagtagcgggcctgcgtgtgggtcgcggcgatggtcaggttgccctgatcctgtgctgcgtaatctttcccgacccttttaaggctttcaacctcctgaagaatccgctcgaccgacgcgaggatgatcctgcccggctcggtgagcgagcgcacgcgcttgccgtgccgcgtgaagatctccacgccgagctcgtcctcgagctcgatgatcgccttcgatacccccggttgcgacgtgtagagcgccttggcggcctcggtgaggttgaaattctgccggacggcctcgcgcacgaagcgaaattggtgcaggttcatttataacccttccgcatatcaacagaatttttagtcgtttgaaatataaggcgagtttattacgattcaccggagtttttcaaatatggatatctgttttcgtcattagcaatccagccgccagcggttgggggcggtgacggcggaacggagattcgggcgcgacgtggctaggacgtcgcgcggtcaccacgaaaaccctggggtccccgaatgtatcagtacgaccaatacgaccagacgatcgtcgacgagcgtgtcgcgcagtaccgcgatcaggtgcgccgccggctgtcgggcgagttgagcgaagaagaattccgtccgctgcgcctgcagaacggcctgtacatgcagcgccacgcgtacatgcaccgcatcgcgattccgtacggcaacctgcgcagcgaccagctccggatgctggcgcgcatcgcccgcgaacacgaccgcggctacggccacttctcgacccgctcgaacatccagttcaactggatccagctcgaggaaacgcccgagatcctcgcgaagctcgcgtcggtgcaaatgcacggcatccagacgtcgggcaactgcatccgcaacatcacggccgaccagtttgccggcgtcgcccaggacgaagagatcgatccgcgcccgtggtcggaaatcctgcgccagtggtcgacgttccatcccgaattcgcgtggctgccgcgcaagttcaagatcgcggtgtcgggctcgaaggacgaccgcgcggccgtgcagattcacgacctcggcgtgtacctgaagaagaacgcgcagggcgaagtggtcgcgagcatcctcgcgggcggcggcctcggccgtacgccgatcatcggcgcggtgatcaaggaagacctgccgtggcagcacctgctgacctactgcgaagccgtgctgcgcgtgtacaaccgctacggccgccgcgacaacctgtacaaggcgcgcatcaagatcctcgtgaaggcgctgtcgcccgcgaagttcgcgcagcaggtcgaggaagagtggcagcacctgaaggacggcccgtcgacgctcacgcaggcggaagtcgatcgcgtgtcgcagtacttccagccgcccgtctacgagaagctggccgacaccgacgcatcgttcgaacagcacctgctcgagaacaaggcgttcgcgcgctgggtcgagcgtaacgtcgcaccgcacaaggtggccggttatgcagccgtcacgctgtcgctgaaggatcaccgcatcgcgccgggcgatgcgaccgaccagcagatggacctggtggccgactgggccgacgcctattcgttcggcgagctgcgcgtgtcgcacgagcagaacctgattctcgcgaacgtgaagaagcgcgacctgttcgaggtttgggaaaaggcgaaggcggccggtttcgcgacgccgaacatcggcctgctgaccgacatcatcgcgtgcccgggcggcgacttctgctcgctcgcgaacgcgaagtcgatcccgatcgcgctggcgatccagcagcgtttcgacgatctggactacgtgtacgacctcggcgacctgtcgctgaacatttccggttgcatgaactcgtgcggtcaccaccacgtcggcaacatcggcatcctcggcgtcgacaaggacggcgccgagtggtatcaggtgtcgctcggcggcgagcagggcacgggccgcaacggcgcgcgcctcggccgcgtgatcgggccgtcgttctcggcggaagaagtgcccgacgtgatcgcgaagctgatcgacacgttcgtcgaatcgcgcgtcgacggcgagcgcttcgtcgacacgtacgaccgcatcggcatcgcgccgttcaaggagcgcgtgtatgcggcgcgccaggcagtgaacgcgtaaccaaccgggtagaaggaattagcagatggcttcgattatcaagaaccgcgcagtgatcgacgatgcatggcaggtcgtgcgcgcggcggaagacggtgcactgcccgcggtcgacgcgttgccggccggcaaggtgctggtgccgttcgcgttgtggcaggccgagcgcgcggcgctcgtcgccgcgaagacgaaggacgagctcggcgtgtggctcgccccggacagcgagccggccgatctcgtggccgacttcggcgcgatttcgctggtcgccgtcgacttcccgcgcttcgcggacggccgcggctacagcatcgcgcgcctgctgcgcgagcgccacggctggacgggcgaactgcgcgcgatcggcgacgtgctgcgcgaccagttgctgtacatgtcgcgttgcggcttcgacgcattcgcggtgcgcgccgacaaggacatccacgacgcgctgaacgcattcacggaattcacgcagcgttatcagggcgcgttcgaccagcccgaaccgctgttccgccgccgcgccgcggcggccggcgtggcgcaagcgaaggtgggcgcatgagcaccgccgccgccaccgcgctgagcccggaactcgccgcgaaggtcgagcgcctcgacgcgctgctcgcgcagatcggggcgcgtcacgagaaggtgaagttcgcgagcagtctcgcggcggaagacatgctgctgacgcacgcgatcctgtcgaagggcgtccggatcggcatcttctcgctgaacacgggccgcctgcacgcggaaacgctcggcatgatcgaccgcgtgcgcgagcgctacggctacgagatcgagcagtttcacccgcagcaggacgcggtcgaccagtacgtcgccgagcacggcctgaacgcgttctacgaaagcgtcgagctgcgcaagtcgtgctgccacatccgcaaggtcgagccgctgaatcgtgcgctggccgacgtcggggcatgggtcacgggccagcgccgcgagcagtcggtcacgcgtgccgagctgcacgaggaagagcaggacgaagcgcgcgggatcgcgaagtacaacccgctcgccgactggacggaaagcgacgtgtgggcgtaccttaacgcgtttgacgtgccggtgaacccgctgcatgcgcgcggctacccgagcatcggctgcgagccctgtacgcgggcgatccgccccggcgaggacagccgcgcgggccgctggtggtgggagtcgcgcgacacgaaggaatgcggcctgcacatcacgatcacgccgattcccgcggacgccgttgccggcgccacgcactgaaagcctgacaagaaactgaatattgcgccgcccgcgacagcgggcggcacgaacccagaagagaaggactgaaatcatgagcacgacgctcgagcaatccgcctttgccccgcccgccggtgccgacaagcgcatgggccacctcgactggctcgaagccgagtcgatccacatcctgcgcgaactggtcgccgaatgcagcaagccggcgctgttgttctcgggcggcaaggattcggtcgtcgtgctgcatctggcactgaaggcgttcggcctcggcgcgaaccgcaagacgacgctgccgttcccgctcgtgcacatcgacacgggccacaactacgaagaagtgatcgacttccgcgatcgccgcgcgaaagaactcggtgccgagctggtcgtcggtcacgtcgaggattcgatcaagcgcggcacggtcgtgctgcgccgcgaaaccgattcgcgcaacgccgcacaggccgtcacgctgctcgagacgatcgaacagcacggctatacggcgctgatcggcggtgcgcgccgcgacgaagagaaggcacgcgcgaaggagcggatcttctcgttccgcgacgaattcggccagtgggatccgaaggcgcagcgcccggaactgtggagcctgtacaacgcccgcctgcacaacggcgagcacctgcgcgtgttcccgatctcgaactggacggaactcgacgtgtggcagtacatcgcgcgcgagaacctcgaactgccgtcgatctactacgcgcaccagcgcgagatcgtgcgccgcaacggcctgctcgtgccggtcacgccgctcacgccgatgcgtgacggcgagacgagcgagctcgcgcaggtgcgcttccgtaccgtgggcgacatcagctgcacgtgcccggtcgagagcgacgcggacgacgtcgagaagatcatcgccgagacggcggtgaccgagatcaccgagcgcggcgcgacccggatggacgaccaggcctccgaagccgcgatggaacagcgtaagaagcaaggttatttctgaagcacacgaggacattcacatcatgagcatcatcgagaacaccgaagacctcggcgtgttgcgcttcatcaccgcaggcagcgtcgacgacggcaagagcacgctgatcggccgcctgctgtacgacagcaaggccgtgctgtccgaccagctgtccgcgctgtcgcgcgcgaagaacaagcgcacggtcggcgacgagctcgacctcgcgctcctgaccgacggtctcgaagccgagcgcgagcagggcatcacgatcgacgtcgcgtaccgctacttcgcgaccgcgaagcgcaagttcatcatcgccgatacgccgggccacgagcagtacacccgcaacatggtgacgggcgcatcgaccgcgcacgcggcgatcatcctgatcgacgcgacgcgcgtgacggtcgagaacggtgtcgccgacctgctgccgcagaccaagcgtcacagcgcgatcgtcaagctgctcgcgctgcagcacgtgatcgtcgcgatcaacaagatggacctcgtcgactacagcgaagcgcgcttcaacgagatccgcgacgcgtacgtcacgctggcgaagcagctcggcctcaccgacgtgcgcttcgtgccggtgtcggcgctgaagggcgacaacatcgtcggcgcgagcgaacgcatgccgtggtacgcgggcgaaccgctgctcgacgtgctcgaatcgctgccggtcgagacgcaggcgcatgacgcgctgcgcttcccggtgcagtgggttgcgcgccaggacggcagctcggccgacgatttccgcggctacatgggccgtatcgagtcgggcgaagtgaaggtcggcgacgagatcgccgtgttgccgtcgaaccgcacggcaacggtcgccgagatcgtcgcgccggtgccgggcggcaccgcgtcggtcgcgcacgcgttcgcgggccagaccgtgacgatccgcctcgcggaagacgtcgacgtgtcgcgcggcgacatgttcgtcacctccggcgagccggttgcaccggcgaagaagctcgaagccgatttgtgctggttcgacgagacgccgctgtcgccgcagcgcaagtacctgctgaagcagaccaccagcacggtgttcgcgaagatcggcggcgtcaagcaggtgctcgacgtgcacacgctgtcgcatgcgaccgaccgtcacgacctgaagatgaacgacatcggccgtgtcgcgctgacgctgcagaagccgatcgtctgcgacacgtacgacgcgcatccgggtaccggtgcgttcgtgctgatcgacgaggcgacgcatcacacggtcgccgcgggcatgatccgggcgttctcggcgtaatcgtcaatctgcgcggcaaaccgcgctgccacacggcggcgcgggccgtatgcaaacgtccgcacggacgaagcgaagcgacaaacatgggcaaggtgtatctgatcggagcagggccgggcgcggcggacctcatcacggtgcgcggcgcgcggctgctcgcgcaggcggacgtcgtgctgcacgacgcgctcgtcgagcccgcgatgctcgactacgcgccgaacgcgcaccggatcgcggtcggcaagcgctgcgggcagcgctcgaccgcgcagcacttcatcaacaagcagatcgtcgatgcggcgcgcgagcacgcgtgcgtcgtgcggctcaagggcggtgacccgatgctgttcggtcgtgccgaagaggagatgcgcgcgctggaagcggccggcatcgactacgaggtcgtgccgggcatcactgcggcactggccggcgcggcgacgctgaagcgttcgttgacgctgcgcggcgtgtcgcgcagcgtcgcgttcgcgacgcacagccgcgcgccgggcagcgacgagatccgcgaagccgcgcgcgccgattcgatcgtgtactacatgggccgcgacagcgcgcccggcatcgcgcaggaactgatcgacgcaggccgtgcgccggcgacgcccgtggcgatcgtcgaggcgtgcagcaccgcgcgcgagcgcacgctgacgctgacgctcgcgcagatggcggcgggcgacgcgcaggcgtggctcgatcccgcggaaccgagcctgctgatgatcggcgatgcgttcgccgagcgcgccggacaggcgaaagagggcgattcgctgcgaaatgcggcctgagcggggcgacctgagcggaatcccgccgcagtccgaaacaaaaagcgccggcttcatcaagccggcgctttttctttgtgcacgctaaccgctaaccgcgcggcttacgcgttgccgtcgatctggtcgatgcagtagcgcgcgatcgcgtcgagcacgccgtcgtcttcgccgacggccgtcgcgcaatggatctcgatgcccggatgcgcggcgcggcacgcatcgacgagttgcggcagatcgcggcggatatggccgccctggccgaagaacacgggcaccacggtgatgtgcgagcagccggccgcgacctgcgcggcgaccgcgtcaccgagcgtcggcgtcatcagttcgaggaacgcgagcgatacgtgggccgcggggaggcggcaccgcgcagccgcgcggcgagccgctcgaacggctcggcccagcgcgggtcgcgggcgccgtggccgaacaggacgatgccgtgcgaactcatgtcgaagcctccgtcgtgacgcggcgctcagtgccggtcgacccacttgagcgcgaacaggccgagcgcgagatagatcaggcccggcgtcgcggcagtgagcggcgcgggccacgtgttcagcgtgccgatgtgcgagaacagcgtgttgaggagctggaagctcatgccgagcatgatgccgccgaacaccttcacgccgaccacgccagcccgcgtgtgcaggtaagcgaacggcagcgacagcacgagcatcacgaacacggcgaacgggtacagcagcttgcgccacagtgcgatgtcgtagcgctgcgtgtcctgctggttctcgcgcaagtgctggatgtagcggaacaggttgatgagcgacatgcgctccggcgacacgagcagcaccgacaggatctgcggcgtcaggtccgaacgcagccggtattcgggcagcgatacctgctgcgaccggtacaccgggttgagcgcgtcggccggctggccgctgatcggcttgatcggcgtcagctcggtttcggagacgcccttcagcagccagtggccgggcggctcgtagcgtcccgtctgcgcgatccgtacgttctgcagctggaatttcgagtcgaattcgtagatgcgcacgttgctgatcgtcgagtcgggcgacaggctgccgacgttgacgaaacgcgtgacctgctcgccgttttcgcgggccgcgagcgtgtccttcacccacacgcccgactggaagttcgacgacaccgatgcgccgagcgcctgcagccgcacgcgctcggacagctgatcggcgtacgggccgacgaattcgccgatcaggtaggtgacgatcacgagcggaatgccgatcttcagcagcgagcgcagcgcctggttggtcgcgagacccgacacgcggaagatcgtgaattccgagttcgcggccatttgcgcgaacacgtagatcgcgctgatcagcgcggcgaccgggatgatctcgtaaaagcgcgacggggtctgcagcgcgacgcgcagcaccgcgtagccgaacttgtagttgccgtgcccgaccgagttcagttcgctgatcaggtcgaagaagaagaacaggcccgagaacgcgaacaggatgaagacgaacgtgacgtagatctgtcgcgcgaagtacttttcatagagccgcatcgatcatgctcccgagcggccgaacagcgcgcgtgtaaacagcggacgattgcgcacgcgcaaccagaagatgaacgcgacgatcgcggcgacgacgaggtgcaggccgaccaggccgacgccgaacgacatcttgccctgctcgatctgcgcctgcacgacgttcagcaggttcgagtacgtgaggtagatcagcacggccatcacgaggttgatcgtgcggctgcggcgcgggttctggtacgacagcggaatgccgagcaccagcaggttgatcgcgatcagcggcagccccgcgcgccacgcgaattccgcgaggttgtcgcgcgtcgggttgcgcagcaggtccggtgtcggggtgctgttcgtggtcggcacgttggtgaccggcgtgctcgtgatcttcacgccgtagcgctcgaactccatgatcttgaagttcggctggccgggcgtgccgtcgtagcggcggccgtcttccaggacgacgaagcggctgccgtcgcgcgtttccgtgtgacccgtctgcgatacgaccacgttgaccttgccgttctcggtcgacgtgacgaacacgttctgcaccttgctctggtcgggcgtcatcttctcgatgaagaacacgcggtggttcgtggccgactcgcggaactggcccggcgcgagcagcgagatctcgtcgcgctgctggaagcgtgccttgatcatcttgctttgctggttcgaccacggccagccgacgaacgcgaagaaggcgatcagcaggatgatcggcgtggcgaacacgccgatcggcttgatgaggcgcgtgaggcttacgcccgatgcgagccacacgaccatttcggagtcccggtaccaccgggtcagcacgaacaggatcgacacgaacagcgtgacgacgagcatcacggcgaggtagccgatcacggtgaggccgatcagcacgaggacgtcccgaggatcgatttcaccggacgcggcgtaaccgacgatgcggatcatcatcgtcgtgagcatgatcgtgagcagcaccatgaacacggcgccagccgtactcgcaagctcgcgctggagggagcgttcgaagatcattcttgatgagaagagggcgggaggctgcgcacgcgtagcggagcgctcgcgccgccacgggaaaaatagcggataattgcggctttcatccttagcccagattttatccgaggacaagcgcgatggactttagcataaaaggctgtgattggagcaaaggcgaggcgaaggggttcctgaccgggaagtccgattgcatcgtgcttggcatcttcgaggcgcagaccctctcgggcgcggcgctcgacatcgacacggccaccaagggactgatttcgcgcgtggtgaaggccggcgacatggacggcaagcgcggcaagacgctgttcctgcacgaagtgtcgggcatcggcgcgtcgcgcgtgctgctcgtcggcctcggcaagcaggatgctttcaaccagaaagcctataacgacgcagcgacggccgcgtggcgcgcgctgctggcgaccaaggtcgtccaggtcacgttcacgctcgcgcaactgccggtcgacgagcgcagctccgactggggcgtgcgtgcggcgattctcgcgctgcgcaacgagacctaccgcttcacgcagatgaagagcaagccggaaccggcgtcgcacacgctcaagcgcgtcgtgttcagcgtcgatccgtccgacgaaaaggccgcgaaggtcgcggtcaagcaggccgtcgcgctcgcgaacgggatggatctcacccgcgacctcggcaacctgccgggtaacgtctgcacgccgacctacctcggcaacaccgcgaagaagatcgcgaaggattggggcctgaaggcggaagtgctcgggctcaagcagatccaggcgctgaagatgggctcgttcctgtcggtcgcgcgcgcgtcggtcgaaccgccgcagttcatcgtgctgcactaccagggcgccgccgcgaaggccgcgccggtcgtgctggtcggcaagggcatcacgttcgacacgggcggcatctcgctgaagccgggcgagggcatggacgagatgaagtacgacatgtgcggcgccggttcggtgctcggtacgatgcgtgcggtcgccgagatgggcctgaagatcaacgtcgtcgcgatcgtgccgacctgcgagaacatgccgggcggcaacgcgacgaagccgggcgacatcgtcaccagcatgaagggcctgacgatcgaggtgctgaacaccgacgccgaagggcgcctgatcctgtgcgacgcgctcacgtatgccgagcgcttcaagccggccgccgtgatcgacgtcgcaacactgacgggcgcgtgcgtgatcgcgctgggcggccacaacagcggcctgttctcgacgaacgacgcgcttgcgggcgaactgctcgacgcgtcgcgcgaggcgaacgacccggcatggcgcatgccgctcgacgacgagtaccaggatcagctgaagtcgaacttcgcggatctcgcgaacatcggcgggcgcccggccggcgccgtgaccgccgcgtgcttcctgtcgcgcttcaccgacagctatccgtgggcccacctcgacatcgcgggcaccgcgtggaagggcggtgcggcgaagggggcgacgggccgtccggtgccgttgctcgcgcagttcctgatcgaccgcgccggccagtgatggcggtgttgacgacgctgcgggtacgcgggcaatgacgcggatcgatttccactcgaacgtcggcgattcgctcgcatacgcgtgccggctgctgcgcaaggcctaccaggccgggcagccggtcgtcgtgctcgccgagcccgcgcgcctgcgcgcgctcgacgagcggctctggacgttctcgccgctcgatttcatcccgcattgcggtgtcgacagcgagcacgcagccggcacgccgatcgtgctggccgcggatctcgacctcgcaccgcatcatcacgtgctgctgaacctcggcgcggccgtgcccgcgcagttcgcccgcttcgagcgcctgctcgaagtggtcggcaacgcgccggacgaactggccgcgggccgcgaccgctaccggttctaccgcgaccgcggatacgcgctgaacaactacaagcagggcagctagccgcaaccgtcgacggagtgttcccgtgacagaagccgattcatcctcgattccgacgctgacagacgtgctggtgccgggcaagccggtgccggcgcgcgtgcccgcgcccgacgctccgcagccgcccgccggcgcggcgattccggtgctgaccgacgtggtcgcgccacgcaccacgggtgcggcgccggccgattccatgcccgccgcactcgaccccgattccgtcgtggtcgaacccgtgccgacgccggacgtgccggcggtcgaactgccgggcgacgaggcggtggcggctgcgactgtcgccgctgccgcgctcggcgagaccgatgcgccggcggagcccggcgccgcggaacacgtggttgccgaagactcggcggcgatgagtgcgccgctgcgctcgtcgctggccgacgacgatgtgctgccgcacgcgttcgccgcggtggcgcgtgaggctgtcgggcacgcgcgtgaagcgcacatgccggaggccgtcgcaccggccaccgcagtggccgcagcggccgctgcgccgcagcaggacgcgcaggccgtggccgggctgacgccggaagatgcccagcacatcgccgagcgcctgcgcaatcgcctgacgaactatctgaccggggaagggcgcgacgccatcgaggcccgttgtcgcgacgcgctgcatgagcattcggcctggctggtcggccagatcacacgcgaagtggcgctggcgctggaaaccgaggtgatggactgggttcgcgacgcggtcgacgaagaaatcgcacgccgcgccggtcatgccggttgagtacgcggccgttcaggtgaaaaacggggtgcgattccagtaagggccggccaagcggccggcgaggtgcgggtcagcctcggcgagcctgcctgccggcggaaccccgcgcgacggcggtttacgcccgttgcgcccggatcagcgcaccgacagcgcccattgcgcgagcgtgtgggcttcggcgctcgtcagttgcgtattggcgggcatcggcacactgccccatacgccgacgctgcctttcacgatcgattgggcgaggtaatcgacggcgtcgccgcgcgccgcatacttgccggcgatgtcgcggaacgacgggcccatcagcggtttgccgatcgcgtggcaggccatgcagttcttgcgctgggcaagcgcgagcccgtcggcctggtcggcgcgcgccgccgccccgctgccgatcagcagcgtggcgagcaggacgcgcaatatcgagtgtttcatgcggttctccgccggcggggacggccggcttcatgacccgcgcattataaaagcaaagggaaagcgcgttttgcgcgttccccggcggccctgcttaacggggtcgcatgcggcgatgcacccgtgtcaacccgtgacggcaccctggttcgcgggccgggcgagtgccgcgaatttcgcgagcacgcctcgcgtgtagcgcggtgccggctgttgccacgcggcgcggcggcgcgcgagttccgtgtcgtccacgttcaactgcagcagcagccggtgcgcgtcgatcgtgatcgagtcgccctcctgcacgagcgcgatcgtgccgccgacgaacgcctccggtgcgacatggccgaccaccatgccccaggtgccgcccgagaagcggccgtcggtgatgaagccgaccgattcgccgagccccttgccgatgatcgcggacgtcggcgcgagcatttcgggcatgccggggccgcccttcgggccgagataacgcagcacgaggatgtcgcctgcctggatccggtcgccgagaatcgcatccatcgcgctctgttcgtcgtcgaacacgcgcgccgggcccgtgatcacggggttcttcaggccggtgatcttcgcgaccgcgccgtcttccgcgagattgcctttcaggatcgcaaggtggccttccttgtacagcgcgcggtcgatcgggaagatcacgtcctggtccgcgcgcggcacggcgggcacgtccttcagttcgtcggcgatcgtgcggccggtgatcgtcatgcagtcgccgtgcagtagccccgcgtcgagcaggatcttcagcacctgcggaatcccgccggcccggtgcaggtcggtcgcgacgtacttccccgacggcttgaggtcgcagatcacgggcacgcgcttgcggatgcgctcgaagtcgtcgatcgtccagtcgacctcggccgcgtgcgcgatcgcgagatagtgcagcacggcattggtcgaaccgcccgtcgccatgatcaccgacaccgcgttctcgatcgattccttcgtgatgatgtcgcgcggcttcaggtcgcgcttcacggcctcgaccagcacgcgcgccgactcggcggccgaatcgactttctcctggtcggggttggccatcgtcgacgagtacagcagcgacatcccgagcgcctcgaacgacgaactcatcgtgttcgcggtgtacatcccgccgcacgaacccgacgtcgggcatgcgttctgctcgaccccttcgaaatcctcctgcgacatccggcccgcggtgaattcgccgacggcctcgaacgacgagacgatcgtcaggtcccggcctttccagttgccggggcggatcgtgccgccgtacacgtagatgcccggcacgttcaggcgcgcgagcgcgatcatcccgcccggcatgttcttgtcgcagccgccgacgacaaccacgccgtccatccattgcccctgcacgcaggtctcgatgcagtcggcgatcacctcgcgcgacacgagcgagtacttcatgccttcggtgcccatcgacatgccgtccgaaatcgtcggcgtgccgaagatctgcgggttcgcatcggaggccttcacggccgcgacggctgcatccgacaggcgctgcaggcccgaattgcacggcgtgatcgtcgaatggccgttcgcgatgccgatcatcggcttgtcgaaatcgtccttctggtaaccgagcgcgtaatacatcgagcgattcggcgatcgggccacgccttgcgtgatgtgcctcgagcggcggttgtaagccatggggactccatcgttgtctgggcggcgccggtgaacggcgcgccggttcggatcagtcaagcatggagtttccggattgggatgtccaatatattatttgtcgcctattaagtcgtttcctgaatgaaagatgcatggctgatccgactcccgacctgcgccagtggcgctatttcgcgaccgttgcggacgagcgccatttcggccgcgcggccgaacgcctgtcgatgacgcagccgccgctgtcgcaggcgatccgcgcgctcgaggacacgctcggggtcgcgctgttcgtgcgcagcaagcgttcggtggcgctgacggcggtcggggccgcgctgttgcccgatgtgcgccggctgcttgcgtcggccgatgcgttgccgccgctggcgcgacggctcgcgcgcggcgaggccggctcgttgtcgctcgcgttcgtgtcgaccgccgattacgggctgctgccttcgctgctgcgtgcgttcggcgcgcgttatccgcaggtgcgcctgcaactcgcggaggcgacgagcgacgtgcagatcgacgaactcgtcgccggccgcatcgacgcggggctcgtcattccgcccgtgccgccgcgccacgcggccgggctgtcgtacctgcccgtcctgcgcgagccgctggtgatcgcgatgccggcggccgcgagcgacgcgcctgaagacgagcccgttcatcttgcggaagtcgccgcgttgccgctcgtgatctttccgcgtcgtttggcgcccggctttatgacatcattacgggctgctacggcgcggcgggaaacccgtgcatcggccaggaggcgatccagatgcagacgatcgtcagcctcgtgtcggctggcatgggcgtcgcactggtgccgcaatcgctgcgtaacctgcggcgcaccggcgtggtctaccggccgctcgccggtcacgcgccggtcgtcgagacgggcctcgtgtggcgtaccggcgacgtgagccccgtgctggccggcttcctcgacgtcgtgcgcgcgcagggctcgccccatgacgtgaacgatggcgcgccggtgccgtccaacgcgcggtactgcgcgtgtgcgacggccgtaccgcattcgaaaacttcttcgctaacccatgatcattcacccgaatttcgaccccgttgcgatccatctcgggccgctggccgtgcgctggtacgggctcatgtatctcgtcggcttcatcgcggcgatcgtcgtcggccggatccgcctgaagctgccgcacgtcgcggcgcagggctggaccgtgaaggacatcgacgacatgatgttctacggcgtgctcggcaccgtgctcggcggccgcctcggctacgtgctgttctacaaggccgatttctacttctcgcatccgctcgacgtgttcaaggtgtgggagggcggcatgtcgtttcacggcggtttcctcggcgtgacgctcgcgatggcgctgttcgcgtggcagcgcaagcgccattggctgcaggtcaccgatttcgtcgcgccgatggtgccgacggggctcgcggccgggcggctcggcaacttcatcaacggtgaactgtggggccgcgtgaccgatccgtccgcaccgtgggcgatgctgttcccgggtgcgatgcgtgacgatgcggcgtggttgccgaagcatccggaactcgtcgagaagtggcatctcgccgacgtgttcatgcaataccagatgctgccgcgtcatccttcgcagctctatgaaattgcgctcgaaggcatcgtgctgttcttcgcgctgttcttcttcgcgcgcaagtcgcggccgatgggcgccgtgtccgcgctgttcttgatcggctacgggctcgcgcgcttcacggtggagttcgcgcgcgaacccgacgacttcctcggcctgctcgcgctcggcctgtcgatggggcagtggctgtcgctgccgatgatcatcgcgggcatcgcgttgatggtctgggcgtatcgccgccgcgcggcgaatgccgttgcgtgatgtgatgacgatgcacgcgcgatcgacgcgtgcatcggcccacgtgaaatgaaaaacgccggccttcgggccggcgtttttcatttcgaccgccgcgcgctgcgtgttacttcatctgcacggaaccgttgacggtgaccgacacggtggccttgcctccttcgaccgcgatcggtgcgctcatctttgcgctgtccatcggtgccgcggccatcgccatcatgcgcggatacggctgcacgttgcggccgctgccgacgttcacgtcgcggatcgtgtagctgctgtagccgaatgccttcgcggcttcgtccgcgcgggcgcggaacgacttgatcgcctcggtcgtcagcttctgctcggctgcgcgctgcgcttcgggcgacagcgagaactcgacgttcgcgacctgcatcaggttcgacaactggccggccaacttcgacgccgcggcgaaatcgcgcgattcgagcgcgacctcggtgcggccgcgccatgcggaaatcttgccgtcgcgatcggtgctcggatagacggagaatgcgcccgtgtgtgccgtgacgcccgatacgcttttcgcttgcgacagggcggcgtcggcgcgctggttcaactgcgcggtgaggctgcccggatccttggcctgctgctcgtagaacagcgtgatgtggatgatgtcctgcggcacgtcggcgctggcttgcgatgacagcgacagcacgcctgccggctccggaaagtgcgggttcgcggcctgcgcgtgcgcggcgggtgacgcgagcgtcagcgcgacgggaacggcggcggcaagggcgagcgacagcgcgagtgcggatttcttggtcattgttggactccttgtgcgagggcgcgcacgcggatcacgcgtgcgcgacgcgggcgtaccgcgcgacgaaaaacgacggccggcttgatcggccggcagcggttgcttaggccgcgcgaaagtgccgcgagttccgtggcagcggcgcgtactgaccagatttgacgtttggcgtgcgcctacttcatcagcttttcggtgatgaaccgccattcggcgcgcgtgacgggcgtgatcgacagccggttgccgcgtgcgagcacgcgcatgtcggcgagttcgtcgtgttcgcgcagcgtggcgagcggcacgagcggcgatttttcacgtagcgcacgtcgacgagcagccagcgcggcgcttcccgggtcgacttcggatcgtaatagggcttttcggatcgaactgcgtggggtcggggtagggcgtcgacgacacttcggcgaggcccgcgatgcccggctcggggcagctcgagtgatagaacagcacaccgtcgccgatcttcatcgtgtcgcgcatgaaattgcgcgcctgataattgcgcacgccggtccacggcagcgagcgctgcggtgcgttggcgagatcgtcgatgcttgcttcgtccggttcggacttcatcagccagtattgcatggatcgtgatcgacgcagaaagaggctgctacaaagaaaacggcaccgggcttcgcccgatgccgttggataggccccgccttggccgctaggccggcatcctgaacctgaggttcagaattggtcgcagttagcagcacttcgggtacatcagacagagtgacgcgcgcgcccgtgctacaaatttccgcaaccgtgcacatggcattggttcaaggaatatatgaccttggcgaaccaggcaggaagctgactgaactgtgattcgatgcgccaatttgaccaccgttgatcgccgagatcaaggggaatcgacgcatcgattaaaacgttactgcgtctcgtgctgtgcgagcaccgcgccgagctgttcgttcatctggtgcattgtacgacggatttcctccgccggaaatgcttcaccgtgccgcacgctcgtttgcagccgcagcaattcggaagcgagcgacagcgccgccatcacggcgatgcgatcggtgccgcgtaccgagctgttcgagcggattttcgacatttcggcgtcgacgcgcgcgactgcttcgagcagtgccgcttcggtctcggccgagcaggcgagccgataggcctgaccgagaatcgagacttcgatctgcttggtgctcatgcatgttctccgtggctggccgcgtcatcgccatccgtacgcgcctgcgcatccagcaggtcgagctggttgtcggcttgctccgcacttttcgagcgcggcagcttttcgagaatcgcgttcagtttcacctgggcgtcgtcgatctttgccgacagcgtgtcgcgctcggccgcgagcgcattgcgttcgtcgcgcagttgcgcgagttccgcgcggaccgtgtccgcgtccgcgcgcaattgcgcgacctgctcctcgagcgcgagccgttccgagtgatagcgcttgttcagcgaaatcagacggccaatattttgagatagggtttcgagttcgttgagcatttgctgcgtcctctaaagacccagcattttagcgcggaataacgcgcaaaccgacatctgtaacgtttccagtcgtaacaccctgcttcttgccgcgaatcagcgcgtcacgtgcgtgtccggatgcttccttgacgctcgtgcgacccgctcctaaactggcgccgcctcggtgctcgcgcgtgcaacgcgcggttaaacgggaagcagggcgcgggctccgccaggaagccgccaacctgcgctgcccccgcaacggtaagcggccgcgttgcatgacgcaggccggctcgggcgcgttccgcatgcacgtttcgcatgcggacgcgggccactgcgcgtcttcgcgcgggaaggcgagccggaccgccgccagcccggataccggccgaggcggggagcccgcacgggcttcgtgacgcgcggcctgcgggaagcggggcgcgcagtgcttcacgggattgatcttcgatgctgaccccaatcgtcggcggcgccgatttctgccatcttgttgacgttctcgaaccgggcgaccaccggaaggtcgtcgcgcgcgtcgaccacctgaccgcaaggatcacgagcttgggtatgcctgcaacacgctgcactgcgccgatgtcgcgcccggcccgcagcggtagcgcgccgatgcgcgcagtgtcgtccgtcgcgcggagggccgcatgagcgccgcgcgcgccaccgcgatctgggccgcattggccgcggcggtcgcgttgctgttcgtcgcgtcgctgtcgatcggcagcgtgccgatgtcgccgtggcaggcgctcgcgtcgctcgtgccgtatggcggcgacgcgctgttcgccgacatcgtccgcacgctgcgcctgccgcgcgcgctcgcgggcttcgcgtgcggtgcgctgctcgcgctggccggctcgttgttgcaggtgttgctgcgcaacccgctcgccgatccgtacgtgctcggcgtgtccggcggcgcggccggcttcgcgctcgtcgcgatgatcgcgggcggcgcatggtggctcgtcgacgtgtcggcgttcgtcggctcgctcgtgtcggtcgcgctcgtgctcggactcgcgcgccgcgagctggggcgcggcgaggcgcgcgatgcgtcgccgcggctgctgctcacgggcgtcgtgatcgcggcggggtggggcgcgctcgtcacgctgctgctgtcgctcgcgcccgatgcgcggctgcgcggcatcatcttctggctgacgggcgacctgaacggcgtgagcacaccgtggttcgcgtggggcgcgctgctgctggccgcgtgcatcgcactgccggccgcgccgcaactgaacgtgctgctgcgcggcgatgcgacggcgctcgcgctcggcgtgcccgtcgcgcgcctgcgtgtgcggatctatctcgtcgcgtcgctggccgccgcggccgcagtgacgaccgccggcacgatcggcttcgtcggcctcgtcgtgccgcacgcgctgcggctcgcattcggcaacgaccagcggatgttgctgccggccgcgatgctcgcgggcggcggtggcgtgatggccgccgacctgctcgcacgcaccgcgatcgcgcccgcgcaactgccggtcggcgtgatgaccgcgttgatcggcgtgccggtgttcctgtggatgttgctcaggaggccgatgcgatgacccgtgccgcattgcgcgccaccggcaacgagatgagctgcgcggccgtcggcctgacgctgaaggctggcgcgcgcacgctgctcgacggcttcacgcaggcgttccgtccgggcgagatctggtgcgtcgcggggccgaacggcgcgggcaagacgacgctgctggcgaccctcgcggggctgcaaccgccggccggcggacacgtcgagatcgacggccggccgctttccgcatggctgcccgcgcagctcgcgcagcgccgcgcgctgatgccgcagcaactgcacgacgcattcagcgcgaccgtgttcgatacggtgttgctcaaccgctttccgtatctcggcggctggggctgggagcgtgacggcgaccgcgcggccgcgcgcgacgcgctggcgaccttcgacctgaccgcgcttgcgtcgcgcgacgtgctgtcgctgtcgggcggcgagcggcagcgcgtcgcgctggccgcgacgctgtgccaggacgcgccgttgatgctgctcgacgaaccgctcgcgcatctcgacctccatcaccagatcgattgcctgaccgcgctggccgcctggctcgacgcgggcccgcgcgcggtgctgttctcgtgccatgatctgaacctcgcgcggcgtttcgcgacgcatgcgctgttgctcgacggccgtggccacgcgtgggccggccccgtgcacgacgtgctgacacccgagcgcgcgagcgacgcgttcggttatccgctcgtgctgatccgcgagaacggccgcgatgcgctgctgccggcgtggcccgagcgacaatgacgtttccttttccgatgcgcggtgcatcccgcgcccacgacacggtttcccgatgacgaccccgacccacttcccgcccgcgatcgcaccgctcgacgacgtgctgcgcaagcgcctgcagcatgtgatcgaccacaagaccaagccgcccggcagcctcggccagctcgaggcggtcgcgctgcaggtcggcctgatccagcacaccgagcggccggtcgtgcagcgtcccgtgatgatcgtgttcgccggcgatcacgggattgccgccgaaggcgtgagcccctatccgcaagcggtgaccgcgcagatggtcgcgaacttcctcgccggcggcgcggcaatcaacgcgttctcgggcgtcgcgcagagcacgctcgagatcgtcgatgcgggcgtcgcgtcgccgctgccgctgtccgaccgcctggtgtcgctgccggtcgcgcgcggcacgcgcaacttcgcgacggaacctgcgatgacgcgcgacgaggcgatgacggcgctcgcggccggcgcggcgcgcgtgcgcctgcacgcgtcgctcggcacgaacgtgatcggcttcggcgagatggggatcgcgaacacgtcgtcggccgcgtgtctgatgagccgcctgctcggcgtgccgatcgacgcgtgcgtcgggcgcggcacgggcctcgacgatcagggcctcgcgcacaagcgcgcggtgctcggccgtgcgctcgtcaagcactcgcacgcgatcgcgccgctcgacgtgctcgcgacgttcggcggcttcgagatcgcgatgatgacgggcgcgtatctcgcggccgcgagcgagcggatgacgatcctcgtcgacggcttcatcgcgacggccgcattgctcgtcgccgagcgcatcgcgcccggcgtgcgcgactactgcgtgttctcgcatacgtcgcacgaggccgggcaccggcgcatgctcgagcatttcggcgcgaaaccgctgctcgcgctcgacctgcggctcggcgaaggcacgggcgcggcgctcgcgctgccgctcgtgcgtgcggctgctgcgttcctcacggaaatggcgagcttcgaatccgccggtgtcgacgatcgtgacgcctgatcgcgcgcgcggcgtgcgggccgaactgcgctacttcttcgtcgcgctcggctacttcacgcgcgtgcccgtgccgcgcgcgatcggttacgcggccggcgatctcgaccaggccgcgcgatatttcccgctcgtcggcgcatgcgtcggcgcgtggggcgcgctcgtgtatctggtcgcgctgcgcgcgctgcccgtgtcgatcgcggtcgggctgtcgatggccgccacgctgctcgcaacggggccttccacgaggacggcctcgccgacagctgcgatgcgttcggcggcggctatacgcgcgacgacgtgctgcgcatcatgcacgactcgcggatcggcacgttcggtgcggtcgcgctcgtgatcgcgctcggcgtgaaatggcaggcgcttgcgtcgatgctgccgttgcgtgccgcatggacgatgatcgccgcgcacgccgcgagccgcgcggcggccgtgagcctgctgatgacgctcgactacgtgcggcccgaaggcaaggcgaaaccggtcgcgcaacggatgggcgcgcgcgcggcgtgtgtcgccgcgctgttcggattaccgtggctgttctggcccgactggcgcatgggcgtcgccgcctgcgtggcgctcgtactcgtgcgcgtgtgggcagcccgctatttcgtgaagcggatcggcggttataccggcgactgtctcggcttcacgcaacaactgtgcgaactggcgatctatctcgtggtgctcggatggacgtcgtcctgatccgtcatccggtcgtcggtgtcgagccgggcatctgctacggacacagcgacgtgccgctcgccgcgccggccgacgccggcgcccaggccgtgcgcgcgcatctgtcggtactcggcgcgccgcttcccgaacaggtctggacgagcccgctgacgcgctgcgcgtccattgccgagcggctcgcgcaggcatgcggcgtgccgctgcaacgcgaggcggactggcaggaaatggatttcggcgcgtgggaaatgcggcgctgggacgatatcgatcgcgcggcactcgatgcgtgggcggccgacctgatgcatgcgtgcgcgcatggcggcgaaagcgtcgcgcgattcgctgcccgggtcgcccggcaggccgatgccgtcgcgcagttcgaccggccgcaatgggcggtcacgcatgcgggcgtgatccgcgtgttcgcggcgcatgtactgtgcgtgccgctcgatacgctgttgtcgcggccggtgccggccggtggtgtcgtctggctgcgcgcggatgccgccacgggaacgtgggaagtggtgcactgggacgaataggcgcaccggcgtccgcatctggacgacgcggcgcgcggtcgatctgtctcaaacaccgacaggtgcgcggcgcgcgctcaagccgccggaactcagcgcgccggccgccgcccacgggcggcttcgagatcctcgcacagcgcggccgcgccctgcgcgatccgcggcgacggccgcgtcagcagatcgccgtcgatcgcgaacaggttgttgcgcgccaccgccgtcagtgcgggccacgtgcgccagcgcgcgaggctcggcaacggttcgtccgtacgcgacgcacccgcgctcgtcgtgacgatcgcctccggattggccgcgagcacggcctcgtcggtgacggtcggcacgagcggcctgagcgaggcgaacacgttgcggccgccgcacagctcgatcacgtcgttgatcaggtgcgcgccattgagcgtcatcagcggccggtcccagacctggaagaacatcgtgacgggcgcccgcgcggcataacgtgcgcgcagcgccgcgatgtcgcgcgtataggcggccgcggccgtatcggcggccggttgcgtgccgagcagcgtgccgagccggcgcagcgacgacgatacgtcgtcgaggtgcttcggttcgctgaagaacagcgggatatgcaatgcgcgcagcgcgtcggtctgccgctcggcgttgccgtgccgccagacgacgatcaggtcgggcttcagcgcggcgatccgctcgagatcgagcgccttgttgtcgccgacgcggggtatcgcttgcgcggcgggcggatagtcgctgtacgtgaccgtgccgacgagcttcgcgccgccgccggccgcgtagacgagctcggtcgcgtgcggcgcgaggctgatcacgcgctgcgcgggtgccggcagcgtgacggtgttgccggcgtcgtcgcgcgtcgtgacgtcggcgtggacgagcggtgcgtgagcgagtgcggtcagcatcgcgaccggtgtcagccggcgcaacaggcgcgcaatcatgcggagtcccgttgcagcagcggcacgcagtgcgcgagtgcgtcgccgaggcgctgccattcggcttcgctgcccggcaggccgacgcgtacgctcgacggagtcgggaagtaccgcgtccagatcccgcgtgccgcgagtgccgcatgcagtgccgctgcccgcgggtcgtcggtccagctgaagagcggcgtcgcgcgggcagcgaagccgtgcgcgcgcagcagtgcggcgagccgctcgccgtcggccgcgagccgctcgcgggcggcggcctgccatgcgcgatcggcgaacgccgcggcgaccgcatggcgcgcggggccgccgaccgtccaggcgccgagcatgtcgcgcagcgcgacgatctggccggggcacgcgagcacgaagcctgcgcggatgccggcgagcccgaagaacttgccgaccgaacgcagcacgacgagccctgggcgatcgacctgcggcgcgagcgactgcgtcgcacccgtatcggcgaacgcctcgtcgacgatcagcgtgccgccgcgcgccgccagttgcgcatgccagccgagcaggcgttcggccggcacgaattcggcggtcggattattcggattcccgacgatgacgtggcgcagcgtcgcaggcaacgtatcggtgccgacgtcgagcgcgacgacgcgatggccgtgtcgcgcgaaagcgggcgcgtattcgccgtacgcgagcgtcgcgacgccggcgtcgccggctggcagcagcgcgggcaatgcgcggatcgcagcctggctgccggccaccggcagcacatgcgcgggatcgggcgcgtggtagtactgcgcggcgcaggccgcgaggccgtcgccgtcgtcgggcagccggcgccacgcgtcggccgggacgggcggcaccggatagccgaccggattgatgccggtcgacaggtcgagccacgtgtcgtacggaatgccgtggcggcgtgcggcttcatgcaggttgccgccgtgcgtgatgcgggtgtcagacatgatgggtggccatgacgagtgcgccgctcgcgaccagcagcgcgagccacagggcaagcgtgcgcgtgacgagcgacaacgcggcgacgatatggacggcgctcgccgtcgcgccggtgccgagcgcgggacgatcctcgatctcgccgtgatagacggccgggccgcccagctgcacgttcaggctgccggcgccggcggccatcaccgggcccgcgttcgggctgtcccagtggcgtgcctgcgtgcgccagcagcgccatgcggcggccgtgtcgccgagcagcgcgtagctcgcggccgtcaggcgcgcgggaatccagttgagcgcgtcgtcgaggcgcgcggcggcccagccgaaggtcaggaagcgcggcgtgcggtagccccacatcgcgtcgagcgtgttcgcgagccggaacagcagcgcgccggggccgcctgcgacgacgaaccagaacagcgcgccgaagatcgcgtcgttgccgttctcgagcgcggattcgacggccgcacgcgacagcgcgccttcgtccgcgtcgctcgtgtcgcgcgacacgatgcgcgcggtcagcgtgcgggcggcgccgaggtcgcgccgcagcagcgccgcggcgattggcgcgacgtggtcggcgaggcttttcgcgccgagtgcgaaccacagcagggcgatgtgcagcgcggccgcgagcggccatggcagcacggccgcgagccatgccgcgacggcgaccggcggcacgaccgctgcgatccatgcggcgacgccgatcacgcggccgcgccggcccgtgttcagcgcgccttcgatgcgcgcggcgaggcggccgaacgcgacgagcggatgccagccggccggttcgccgatcgcgcggtcgatgatcgcggccgcgaccgcgaacatcgcgactacgggcagcgacagcatcagcatgacggcgctcccgtcttgaggtcgagcggcagcccggcgacgagcagcgtcacgcgcgtcgcgagcgcggcgacacgctggttcaggcgcccgagttcgtcgacgtagcggcgcgtgaccgacccgagcggcacgacgccgagcccgatctcgttgctgacgacgatcaccttcgcgcgcgtgccgcgcaacgcgtgctcgagccggtcgacctgcgccgcgtactgcgcatcgtcgagcggttcgccgtcggccgggcacagcaggttcgtgagccacagcgtcaggcagtcgacgagcaggcacgcgtgcggatcgtcgagccgcgcgagcgtgccggcgaggtcgacgggtgcgtcggcgaagccccaggcggccggccggcgcgcgcgatggtgcgcgatgcgctgcgcgaattcggcatcggcggcggttgcggtggcgatgtaggtgacggggcggccgctgtcggcggcgaggcgctcggcgtgcgcgctcttgcccgagcgtgcgccgccgaggacgaaggtgaggtcgtgcggaatcatcgcgtgattgtaacggcgcgggcataccggcgcggggataatgcggcctttgcttcgcgacgacctttacacgatgaatgcacccgagccgcggccgcgcggcacgctgatgatccagggcacgacgtccgacgcgggcaagagcacgctggtcgcgggcctgtgccggctcgcgcgccgcggcggcgcgcgcgttgcgccgttcaagccgcagaacatggcgctcaacagcgcggtgacggccgacggcggcgaaatcggccgcgcgcaggcactgcaggcgctggccgcgggcgttgcgccgcatacggatttcaaccccgtgctgctgaagccgacgagcgaccgcggcgcgcaggtgatcattcacggcaaggcgcgcatgaacctcgatgcgcgcgcgtatcacggctacaagccggtcgcattcgaagcggtgctcgagtcgtacgcgcgcctgcgcgccggctacgacacggtgatcgtcgagggcgcggggagcccggccgagatcaacctgcgcgaaggcgacatcgcgaacatggggtttgccgaacgcgtcgactgcccggtcgtgctcgtcgccgacattgaccgcggcggcgtgttcgcccacctggtcggcacgctcgcgtgcctgtcggacagcgagcgcgcacgcgtgcgcggcttcgtgatcaaccgcttccgcggcgacgtcaagctgctcgaaccggggctcgactggctgcgtgcgcagacgggcaagcccgtgttcggcgtgctgccgtacctgcatggcctgctgctcgacgccgaggacatgctgccggcacaggcgcgcagcgccgccgcacgcggcgatgccggcctgctgcgcgtcgtcgtgccggcgctgccgcgcatcagcaaccacaccgatttcgacccgctgcgcgcgcatccgcaggtcgaattcacgtactggaagagcggccccgtcccggatgccgacctcctgatcctgcccggttcgaagagcgtgcagcgcgatctcgcatggctgcgcgacgcgggctgggacacgctgatccgtcgccatctgcgctacggcggcaaggtgatcggcatctgcggcgggatgcagatgctcggccgcacgctcgacgatccgctcggcctcgaaggggcgcccggcagcgtgccggggctcgggctgctcgatttcgacacgaccctgcagcgcgacaagacgctgaagaacgtgaccgggcatctcgcgctgccgggcggggcggccgtgcgcggctacgagatccacatgggcgatacgcacgggcccgcgctcgcgtcgcccgcgctgacgctggccgccgacgccgcacccgacgccacacgcccggacggtgcggtgtccgctgatggccagatcctcgcgacctacgtgcacgggctgttcgactcgcccgacgcatgcgcggcgctgctcgcgtgggccgggctcgacggcgcggcgcgcatcgactatccggcgttgcgcgaggcatcgctcgagcggctggccgactcgttcgccgaccatctcgatctcgacgcgctgtacgccgagtttcgttgacgcgggccgggccgtgctcgctttttccgccggatcgcatacaacacaggagggcggatgtccgcctggaggagtgcgacgatgaaggctcgatggtggtggagcgtgctgctcgcggcgctgctgggcgtgtcggcggttgcgcacgcgtgcgattcgtacgcaccgggcggcggccagtccggttccggcgacgccacacaaggcaagagcggttactgaagcaggtcgcggggcatgatcggtcatgccccttttatgtcccgattaattccatccgggaatcagttaaagcgaattggcgcgtttatcggttgaatcgattcgaatagagtgcgatccattcacaccactcacgaaggaattcgccatgaatcccaatcgcctcaacgatttcgccgcgaccctgctgcgcgtcgcgctcggcgtgctgtacctcgcgcacgtcgcgcagaaggtgttcgtcttcacgctgcccggcaccgcgcagttcttcgcgtcgatcggcctgccgggctggctcgcgtacctgacgacgttcgtcgaactggcgggcggcctggcgctgctcgcgggcttccgcgtgcgcgtcgccgcgctggtgctgctgccgttcatgctcggcgcgaccgccgcgcatctgccgaacggctggagcttcgcgtcgccgaacggcggctgggaatacccggcgttctgggccgtcacgctcgccgtgcaggcgctgctgggcgacggcgcgttcgcgctcggcgcacgggaagccgcggttcagcgtgcgtaagggggtaagtgggtaagtcggcggggtaagtcggcgaaaacggtgcggcgcaacccgttccggtgacaccccgtttgccgatatcatcgctccctgtatccgcaatcgagcggcgcctgccctgcggcaggggccgcgcggctttcggggaattcatgacggtgatcgtggtggcgaatccgaagggcggcgtggggaagagcacgctgtccaccaatcttgccggctatttcgcggcgcagggcgcgtgggtcgcgcttgccgacctggaccggcagcagtccgcgcatgcttggctcgacctgcggccggccggattgccggcaatcgaggcatgggaactcgatccggacgcgccgacgaagccgccgcgcggcctcgaatatgcggtgatcgatacgccggccgggctgcacggcaaccggctcaacgtcgcgctgcaactggccgacaaggtgatcgtgccgctgcagccgtcgatgttcgatattctggccacgcagcagtttctggagcgcctcgccggagagaaggccgtgcgcaagggcagcgtcgaggtcgggatcgtcgggatgcgggtcgatgcgcgcacgcgctcgtcggaccagcttcaccggttcgtcgaagggctcggcctgccggtgctcggctacgtgcgcgacacgcagaactacgtgcagatcgccgcgcacggcctcacgctgtgggacgtcgcgaagagccgggtcgagaaggatctcgagcagtggcggccgatcgtcgaatgggccgaacgccgcgcgccgaaggccgagaagacggagaggaccgccaaggcgtcctgatcgcgcggccgccgggccgggacgcgatgaaatgagaaagggccggatcccgtggcacacggcatccggcccttcgacccttcaaccgcaagcggcacagccgctccgcgcgcagcggcacgcgggcggccggtcagtcaggtcaggtccagttctgcgtcggcacgtgatcgcggtggcccttgatcttgttgccgtcgtcgatgaacacgagcttcggcttccagccggcctgaatctcggcttcgtcgaccatcgcgaatgccgcgatgatcacgaggtcgccgagctgcgcgcgacgcgcggccgagccgttcagcgagatcatcccgctgccgcgctcacccttgatcgcgtacgtcgagaaacgctcgccgttgttgatgttccagatgtcgatccgttcgttttcgatgaggccggccgcttcgagcaggtcttcgtcgatcgcgcacgagccttcgtagtgcagctcgcagtgcgtgacggccgcgcggtggatcttcgatttgagcatgtggcgctgcatggtgtctccgtgatgcgtcgtgagaggcgcgggcgggcggcccgtcagatttccaggttgtcgatcaggcgcgtcgcgccgagcttcgcggccgcgagcacgacgagcggctcgccggcttcgagttcggcggcgctcggtgcgatcaggttcgcgcggcggcggatcgcgatgtagtcgggcgcccagccgcgctcggccaggtgcgtgcgcgcgtgatgctcgagcttgccgaggtcgcgttcgccgccgagcacgctgtcgcgcacgcgctgcagcgttttcgcgagttcgggcgcttccttgcgctcgtcggtcgtcaggtagcggttgcgcgacgacagcgcgaggccgtcctcgtcgcgcacggtttcggccgcgatgatctcgaccggcagcgcgagttgctggcacatccggcgcacgatcatcagctgctggtaatccttcttgccgaacacggcgacgcgcggctgcacgcaggacatcagcttcgtgacgaccgtgcacacgccggcgaagaagccgggccggaattcaccctcgagaatcccgccgaggtcgtccggcggcagcacgcggtattcctgcggttccgggtacatgtcgcgctcggtcggcgcgaacagcacgtagacgttttcctgttgcagcttctcgatatcgtcctggagcgtgcgcggatacttgtcgaaatcctcgttcgggccgaattgcagccggttgacgaagatgctcgccacgaccgggtcgccgtgctggcgcgcgaggcgcatcagcgacaggtgcccttcgtgcaggttgcccatcgtcggcacgaacgccgtgcggttctgtccacgcaactggtcgcgcagttcctggatcgagctgatgactttcatgatcgggtagcggtttcctcgcgcatgcgcgcgttggcgccgcagcagcggcgtcggggtcgaagcggagaacgccggcgcgcgggcggcgcatcgggcgtcggcggattgtagaggatttggccgccaaacgcatcgaaaaagtacggtcgttcactttttaaccgggcgtgccggcaacggcccgcgcagtcgcgtcgggctgcggcgaggcggcacgtgtgccggattgaatcgggagggcgggaagggcgggcgcgggcgttacgcgggcgccaggcctgttacgcgggcaggtaagcgagacgcacgtagatcggcgcgaacggctcggcctgcgtgatctcgaggagcgattcgcgcgcgagttcgagcatcgcgatgaaattcacgacgacgaccggcacgccgcgcgacgtgtcgaacagctcggcgaattccatgaaacgcgcgttctgcagccggcgcaggatcaggctcatgtgctcccgcaccgacagctcctcgcgggagatcttgtggtgctggacgagcttcgcgcgcttgagcacgtcggcccacgcggcgcgcaggtcgtccgaattcacgtcggggaagcgcggcgtgacgctctgctcgatgtagacctcggcgcgcaggaagtcgcggccgagctgcggcaactggtcgagccgctgcgcggcgagcttcatctgctcgtattcgagcaggcggcgcacgagttcggcgcgcggatcctcggcttcctcgccggtgtcggccttcttgaccggcagcagcatccgcgacttgatctcgatcagcatcgcggccatcagcaggtactcggccgcgagctccaggttcgacgtgcggatctggtcgacgtagcccagatattgcgcggtgacctgcgccatcgggatgtcgagcacgttgaagttctgcttgcggatcaggtagagcagcaggtcgagcgggccttcgaaggtctcgaggaacacctcgagcgcatcgggcgggatgtagagatcctgcggcagcttgaacagcggctcgccgtacaggcgagcgaatgccgcgacaccgtcgaccgtgtcgggcgtcgaatcggcgcccgcgggcgcggcgatcgcgtcgtcctggcgggcggcgctggcctcgtcggcggcgctcacgtcgtcagaagttctggtagtagacgtacgacgtttgcttcacgcgcgattcctgctgctcggcgcgctcttcgaggtcgatcggctgcttgtcccacagcaggaacggcccttgcgctgctcttcctcgagcgtcggcttctgttgcttgagctggttcaggaactgcgtgacatcggactggtacggcatggctggattttccgtttcgggcggcgcacgatgcgccggattcacgatggcgggattttaccgcatcgcgggaacggccggcggcaatcgcgcgtcgaatccgcgggttggcgcgcagccggcggccgcaagcgcgccgccgggcatgacgccgcggccacgcgtgctcgcgcggcggtttacaaacattaagctttgacgccggcacgctgtggtcaaatacagggttttccacaaaaccgtgacaaccgagggcgaggtcatatttggcggggcagtcgaaccagcaagcacatccggcacatgacgcgggcccgcgcgtggaacgcaatcgcgccggcgccgcggcccgtgccgcacgggcgaccctcgcgggctgcctggccgcgtgcttcgcgctgccggcccacgcgaagtacgacgtcgacatcgacgcgccgcgctcggttcgcaagctgctcaagacgcacctcgacatcgcgcgcttcgcgaagcgcgacgacatcagcgacgaccagttcgacttcctcgtgacggccacgccgcagcaggtgcgcgacctgaccgcgacggccgggtatttctcgccggtcgtgcgcaccgacgtgcgtacgcgcgacggcaagcgcgacgtgcgcatcgcggtcgatccgggcaagcagaccctcgtgtcgagcgtcgacctgaccttcaaggggcccgtcgacaccgaggacccgaagcaggaagccgctacccgtttcgcgttttcgctgaagccgggcgacccgttcacgcagtccgactgggacggcgcgaagggcgcggcgctcaggcaactgcagtcgcgtcgttatctcggcgcgaagatcgcgtcgtcggaggcgcgcatcgacccgcgcacgcagcgcgcgacgctcgcggtcacgttcgacagcggtccgacgttcacgatcggcaaggtcgacgtcgacggtgtgcggcgctatccggagaagatcgtcacgaacgtcaatccgctgtcggaaggcgagatctacgacgtgcagcggatcaccgaattgcagcggcagttgcagaacacgccgtactacgcgagcgtcgcgatcgacgtcggcgacgatacggcgaagcccgagcgcacgcccgtgcacgtgaaggtcagcgagttcccgtacaacaacatccgcggcggcgtcggcttcgcgaccgacaccgggccgcatgtgcagggctcctacacgtatctcgacacgttcggcgccgcgtggccgctgaccgtgtcgggccggctcgaccagatccagcaatacgggcaggtccagctgtcgatgccgccgggcgagaaggggtggaccaacagcgtgctcgcgtcgtacacgaacaccaacgtgtcggatacgcgcatctacagcgcgcgggtcggcgtgcagcgcacgcgcacgggccagttcatcgactattcgtattcgctgatgtactaccaggaccggctcgaccagaacagcgcggggccgaccacgagccgcgcgctcgtgccgcaatgggcatggacgcgccgcaacgtcgacgatccgctgttcccgcgttcgggcaacctgatccacgcggaggccggcttcgcggtcaagggcgtgctgaccgaccagaccttcatccgcggctacgcgcgtggccagcagtacctgccggtcggcaagcgcgacctgttcgtgttccgcgcggagctcggcggcgtgttcacgagcggcagctcgaccggcgtgccggcgtcgctgctgttccgcgcgggcggctcgaactcggtgcgcggctacggttaccagagcatcggcaacagcgtcgacggttccgtcctgccgaccaagtacctgatgacgggcaccgccgaataccagcactggttcaaccgcgactggggtgccgcgacgttcttcgacatcggcacggccaccgatgcgtggggcgaacgcgtgttctacccgggcgtcggcgtcggcgcgcgctggcgcagccccgtcggcccgatcaacgtcgacgtcgcgtacgggttgcgcaaccatagcgtgcgcccgtacctgacgctcggcatcgctttctgaacgtaccgcttcatcgacgaaccgcatgacgaaggacccgaacgatacgaacgacacgccgccgcctggcgatccggacacgcccggcggcgcgcccgacgcgccgccgggcgcgccgcgccgcgggcccgtcgcgcgcatcgggcggttcgtcgcatggacgctcgcgacggtcgtgctgctcgtcgtgctggccgtcgggctcgtgctggccgcggtgacgaccgagcacggcacgcggctcgcgtggcaggtggcggagcgcgtgctcggcgcgcggctcgcgggcacgctcgacggcggctcgctcgcgaccggcgtgcggttgcgcgggttcgcctggacgagccccgacggcaccggtaccgaaatccgcatcgaccggctcgacggtcgctgggcattgacccgcgcgccgtggcgtctgtccatcgcgtatcttcgggccggcacgatcgacgtgcggatcccgccggggccgtcgacgccgagtacgacgccgcaggacctgagcctgccgctgcagttgcggatcgacgacctgcgcgtcgatcacctcgctatccacgacggcggctcgacgacgcagctcgaccatctcgcgctgaacggccgcagcgacggtcgtcaccatgaactcgtgctcgacggcgtcgatacgccgtacggtgcgctgaccgcgcgcgcgaaactcgacggcgtgaagccgttcgcgctgacggggaggccacttactcaggcaagctgtccgacgagccggtcgatgcgcgcgctcgcgtgtcgggttcgctcgaggcgctcgtcgcggaagtcgacgcgagcgggatgaagctgaacgggcgcgcgcacgtcgaggccgcgccgttcggcgcggtgccgctcacgcgcgcgtcgctcgcgttcgatcacgtgaacccgcaggcgctcgcgcccggcgcgccggccgccgatctcgcggtgcgcgcggaactcgcacccgtgaccgcgccggccggctcggcgcccgcaaaggggttcgcggtgacgggcccggtgtcgatcgtcaacgcgaagcccggcacgctcggcgaccacctgttgccggtgatcgacgcgcacgcgaacgtgcatctcgacgcgcacgcgcagcggatcgacgcgctcgcgctgaagctgatccgcgacggcagcgtgacgggcaacggcacgctgacgggcggcaagggccgcttcgacctgaaggtcgcgaacctcgacctgaacgccttcgtcgccgagctgcggccgatgcgcctgggcggcccgctcggcgtgacgcttgcggccggcgtgacgaccgttgacttcaacctgaacgatccgaagctcgcgctcggcgcacgcgcgaaggttgcgctgacgccgcagcagaccgtgctgaccgacgcacgcgtgacggcgggcaagggccgcatcgacctgacgggcgtgttccgccacgatgcgcattcgagctacgacgcgaaggcgacgctgaccggattcgatccgctgctgctcgccgcgcagagcgcgccgaaggccggtagcggcaaggcgcctgtcaaggtcgcgaaggcgccgcccaggcgcggcgagacgcgcgtgtcgggcacgctgacggcgtcgggcgcattcgcgccgcaggtgtcgacgaaggcgaccttcaagctcggcgacagcctgtacgacggcgtgccgctgaccggcgccggcgtcgtgcagctcgccggctcgcggatcctgccgagcaacgcgaacctgtcgatcgcgggcaatcatgtcgacctgcgcggcagcttcggggcacccggcgaccggctgcgcttcgtcatcgacgcgccgcagctcgaccggctcggcttcggcgtggaagggctcgtgcaggcgcagggcgacctgaccggcagcttcgcgcacccgaacgtggcggccacctacaaggccgagcacgtcgtcgtcggctcgaaccggatcggtgccgcgcagggtcgcgcggacatccgcgacggcgcgcacggcgccctcgtgttcacggccgacgcgaccgacctcgcgctcggttcgctgaatctgaaatcgctgcgcgcgaacctcgacggtacgcgcgcgaagcacacgctcgacgcgtcggcactcgggacggccggcggccgcgtgatcgacttgacgctcgcggcgaacggcggcgtggtcgagagccgcgacgggatgcgctgggacggtaccgtgacgcggctcgcgaaccgcggcacgccggccgtcgcgctgcaggcgccgctgaccgtatcggtcggtgccggccgcgtaacgctcggcgcgacgcggctcacgctcgagggcgcggcgatcgacctgaagtcgttcgtgttcgatcacggccagatgcgctcggcgggctccgtgagcggcgtgtcggtcgcgcgtttcctcgaggtccgccaggagctgacgggccagcggccgccggtgcgaaccgacgtcgtgctcgacgccgactgggatttctcgctcggcgcgaactcgaccggccatgtgcaggtgaagcggcgaggcggcgacgtgacgatcgagagcgggcgcggcatcgcgtcgctggggctgaccgacctgtccgcgcgcgcgaacttcacgccgggcaaccggctcaacgtgacggcgctcgcgaaggcgaaccggatcggcacgctcgatgcgaacgtcaccgtgccgttcgcgctgcgcgacggcatgttcggcgtggtcgacgacggcccgctgtcgggccgcatcgacgtcgacgtcccggcgctgaagacgaccggcaacctgttcgggccgagctacctgctcggcgggcgcgcggcgctgaagctgaccgtcgcgggcacgccggcgaagccgaacctgtcggggatgctgacgggcgacgacctgtccgcgacgctcgtcgaccagggcgtgcagctgaaggacggcatcgtgcgcatcaagctgtcggaaaacctcgtcgaattccagcaggtcgagttccacggcggcgacggcacgctgcgcgcacttggccgcgtgcgtctcgacggcgaggcgcccgacctgaccgcgagcatcgtcgcggacaagctcgagctgttcgcggcgccggaccggaagctgtcgctgtcgggcaaggcgacggtcgcgaacgacgggccgcgcggcgcgctgtcgatcgacggcaagttcgtcgtcgatcgcgcgttgttcgacctgcccgaggagtcggcgccgcacctgtcggacgacgtggtgatcgtgcaacccgacggcacggtgcgcggcgagacgccgaccggcaccgccgtcgccaagccgaagccggccgcggacaaaccggcgccgtcgctcgcgccgcgcgcgaacatcgacatcggcctcggcaacaacttccgcttcaaggggcacggcgcggatctcgggctgcgcggcacgatcaccgtgatgagcgcgccgggcgtgccgctgcgcgcggtcggcaacgtgcgtgtgaccgaagggtcgacgtacacgtcgttcggccgcaagctcgcgatcgagaacggcttcttcaccttcaacggccccgtgtctaacccgggcgtcaacatcctcgcgatgcggcgcaaccaggaagtcgaggccggcgtgcaggtcacgggcacgatccagtcgctgacggtcaagctggtgtcggaaccgaacgtcacggacaacgaaaagctgtcgtggctgctgttcgggcacggcaccgaccagggcaacaacgtcggccagcagggcacgatgacggcggcgctcgggctgctcggcagtgtgaccggcaagcgcgtcgcgcagaccttcggtctcgacgaggtctcggtcggccgcagcgaggtgggcctgaccgacccgcaggtcgtgctggtgtcgaaggcgatcaacgagcggttcgtgctcggcttcgagcaggggctgcaatcggcgagcaacgcgttcaaggcgacgatcaacctgacgcgcttctggtccgtgtccgcgtacggcggcacgttccagggcgtcgacctgaactacacgcggcgtttcgaccggtggttcggcagcgacgcggcgcgggcgcggcgtgccgagcagccatgaatgaaaaagccccgcacgaaacgaatcgtgcggggctttgtttcgcgccagcggcagcgcgttcggcttacttcacgcgcatgccgggcttcgcgccgctgtgcggctcgaggatgtagaggcccggttccgccttctcgtcggtggccgacgcggcgagcaccatcccttcggacaggccgaacttcatcttgcgcggcgcgaggttcgcgaccatcacggtcagcttgcccacgagctgctcgggctggtacgccgacttgatgcccgagaacacgttgcgggtcttttcctcgccgacgtcgagcgtgagctgcagcagcttgtccgaaccctcgacggtctggcacgcgacgatctttgcgatgcgcaggtcgatcttcgcgaaatcgtcgatcgagatgggggcatcgtcggcgccgttcacggcggccggcttcgcgttcgccttggcgttcttcgcctccttggcggtgttcgcgctcgcggcggccgcgccggtggcctcggcctgcagcgaatcgcggttcgcggcgagcaatgcctcgatctgcttcgggtcgacgcgtgtcatcaggtgctggtacgccttgatcggctgttccgacgacagcggcttcgcggcatcggcccatgcgagcggcgcgatcccgaagaacgactcgacggcctcggccacgcgcggcatcaccggcttcagcgcgagcgacagcaggcggaaagactcgaggctcacgctgcaggtttcgtgcagcgcgaccgcgttggccggatccttcgcgagatcccacggtttcgcgccgtcgacgtacgcgttcacttcgtccgcgagctccatcgtgtggcgcagcgcgcggccgtactcgcgtgcttcgtagtgcgcggcgatcccgggaatcgcatcgcgcagcttcacgacgagcggatggttcatcgcgctgtcctgcacgcggccgtcgaagcgcttgatcaggaagcctgccgcgcggctcgcgatgttcacgtacttgccgacgagatcgctgttcacgcgcgcctggaaatcgtcgaggttcaggtcgatgtcttccatcgtcgcgttcagcttcgcggcgaagtagtagcgcagccattcggggttcaggcccgtgtcgatgtagctctgcgcggtgatgaacgtgccgcgcgacttcgacatcttcgcgccgtcgaccgtcaggaagccgtgcgcgaacacgttggtcggcgtgcggtggcccgagaactcgagcatcgcgggccagaacagcgtgtggaagtacaggatgtccttgccgatgaagtgatactgctcggtggtcgagcccgggcggatccacgcgtcgaagtcgacgccgttgcggtcgcacaggttcttgaagctcgcgtagtagccgaccggcgcgtcgagccacacgtagaaatacttgccgggcgcgcccgggatctcgaagccgaagtacggcgcgtcacgcgagatgtcccagtcggcgagcttggcctcgccggcgtcgccgagccattcgcgcatcttgttggtcgcttcgggctgcgcgaggccgctcacccattcgcgcaggaacgtttcgcagcgcggatcggacaggcggaagaagtagtgcttcgacgtcttgcgcaccggcgtcgcgcccgacacgaccgaatacgggttcagcagttcggtcggcaggtaggtcgagccgcacacttcgcagttgtcgccgtactggtccttcgcgtggcacttcggacactcgcccttgatgaagcggtcgggcaggaacatttccttgacgggatcgtacgcctgctcgatctcgcgctcggcgatgaaaccggcttcctgcagcgcgacgtagatcttctcgctcagcacgcggttctcgtccgaatcggtcgagtagaaattgtcgaacgacacgccgaagctgtcgaagtcgcgcttgtgctcggtccacacgcggtcgatcagctgcttcggggtcagtccttccttctccgcgcgcagcatgatcggcgtgccgtgcgtgtcgtcggcgccgatgtagtacacctcatggccatgcattcgcagcgtccgcacccagatgtcggtctggatgtactcgaccaggtggccgatgtggatctgcccgttggcatagggcagtgcggacgtaacgaggatctggcggccaccttgcggcgccgcagcctgcacggaagtgaggtcggatgcggacatagggtctgtagaggaacggcggaaaacgacgggaaactgcgattctagcagggcgcgcgccggcgacgcgggcagggcgccgctgaccgggcgccggaacgggcggggccgcgcaagcggcgtgcccggcggtgacatgctgcggcgcagcacgaattctgcgggcaaaaaccggggcggatacggccccggagcaacaacgacaagaggagaatggtgacgcgccggcaacaccagccgcgtaccgtaaatactgaccacggcctgcgacagaagttcgaaaatttttcgatttgttaccggctccgccggaagtcttgtccggcggggctgcgcgggcggcgggcccgcgccttccctcgtcgtgcgcttactgcgcctgtgctgcgcgcaggtagatttcgacgcggcggttctgtgcgcggccggcttccgtcgcgttgtccgcgatcgggttcgacgggcccatgccctgtgccgacaggcggccgccggcgacgccgcgctgcacgagcgcgttgacgacgctctgcgcgcggttctgcgacagcgtctggttcagctgctgcgaacccgtgctgtccgtgtagccgacgatcgatgccgtcacttgcgggttctggttcagcgtcgtcgccaggtcgttcagcagcggcgtgaaggccggcgtgatcgcgtactggttcgtcgcgaacgtcaccgagctcggcacgttcagcttcagcgagccgtccggctgctcggtcacctgcgtacccgtcttggctgccgacggcgcgagcttgttcttgatcgcctgccagttgtaacccgtcacgccgccgaccagtgcgccgacgcccgcgccgatcgccgcgcccttgccgccgcccgccagcgcgccgatgcctgcgcccagcgccgcacccgtgccggtaccgacggccgtattgttgccttgctgcgtggcgcagcctgccagcagtgcgccggctaatgcgaagacggacagacgggtcgcgattttcatgttcatcttggattcctctcttggttgaacgagtcgacaacgacgacaacaacagttacggctccacgcgcgggccgcccgaaaaggagggcaggcctgcaccagcggcagccgccgaggtggccgcatgccctgtccgtcagcgtggctgttcgggcagtgcgacgcgtcagcctctacaatataggcggttggtggccgatttggccccatagcatgccgcaggcgaagagtgcgccgggtcgcgcgttcgcgcaatggcgtgcaacagattctttcacttttcccgattttcgcagcgtaatttgatatttttgacgtttgcgcgcgagaaaacgttttcacggagtttcgatgagcattgaccgggcacaagtcgacgccgctttggcggctgtcgtcgaccccaataccggccgtccgtatgcggcgaacaagggcgtgcgcaacgtcgcgatcgacggcgacgtcgtggcgctcggcgtggtgctcggttatcccgcgcgcagccagcacgacgacgtgcgcgcacgcgtcaccgcggcgctccaggccgtgcccggcgtgcgcgacgcgcgcgtcgccgtgtcgcaggagatcgtcgcgcacacggtgcagcgtggcgtgaaactgctgccgaacgtgaagaacatcgtggcggtcgcgtcgggcaagggcggtgtcggcaagagcacgaccgccgtcaacctcgcgctcgcgctcgccgcagaaggcgcgtcggtcggcattctcgacgccgacatctacggcccgtcgctgccgacgatgctcggcatccacggccagcgccccgagtcgcccgacaaccagtcgatgaacccgctcgtcggccacgggctgcaggcgaactcgatcggcttcctgatcgaggaagacaacccgatggtatggcgcggcccgatggcgacctccgcgctcgagcagttgctgcgccagaccaactggcgcgagctcgactacctgatcgtcgacatgccgcccggcacgggcgacatccagctcacgctcgcgcagcgcgtgccggtcacgggcgcggtgatcgtcacgacgccgcaggacatcgcgctgctcgacgcgaagaagggcctgaagatgttcgagaaggtcgggattccgatcctcggcatcgtcgagaacatgagcatccacatctgttcgaactgcggccacgaagaacacatcttcggcgccggcggggccgagcggatggcgaaggattacgacgtgaacgtgctcggcagcctgccgctcgacatcgcgatccgcgagcgggccgacagcggcacgccgacggtcgcggccgatcccgaaggcgcgctggcccgtcgttaccgcgacatcgcgcgcggtgtcgcactggcgattgccgagcgttcgcgcgacatgacttcgaagtttccgtcgatcgttgttcaaaatacgtaaaacccttgcggggcggggcctcacgctgtttacggcgccgcgaggcgcggtatcatggcgacttttcccgggtccctttacccgcccggcgcggccgtcgtgtcaaacggccgccagccggcatgaggatcgaatgaaacaacgacatcacggcgtgcgcgccggccgcgtgcggtacgcgctgctggccgccgccgcgctgggcctgctggccggctgcacctcctttcctcgtcgcacgaaaaacgggccgacgcacaactgcagccgacggtcggctcgcaggcgcgcggcgcggtgacgttcgtcgagcgtccggacggcgttcaggtcacgtacaacctggccggccttccgcccaacagcgatcacgcgctacaggtgcacgaacgcggtgactgcaacgcgggcgacggctcgagcgccggccaggtgttcgcgccggccgccgaccggctgcgcgcgggcgcccgcgtcgcaggcgatctcggcaacatccatgcggacgcgaacggcgtcgcggccggcttcatcgtcgcgcccgatctggccctcgatggcgtgcgctcggcgatgaaccgcgcggcgctggtgcaccgcgactcgagcgatcccgcgtttccgcagcatggcgcggggcccgcgctcgcctgcggcgtgatccgttgacggctgccgcgtgcgtgcgccgatgatcgcgtaaaatgtccgcctttcccggccgccgtctcgcgcgagcggccctccctgactgtcacgcagcgtttccaggcgccccgatatgagcatcaagtccgacaaatggattcggcgcatggccgaagagcacaagatgatcgagccgttcgtgcccgatcaggttcgcgcgtccgaggacggccgccggatcgtcagctacggcacgtcgagctacggctacgacatccgctgcgcggacgaattcaagatcttcacgaacatcaactcgacgatcgtcgatccgaagaacttcgacgagggttcgtttgtcgatttcaagggcgacgtgtgcatcatcccgccgaactcgttcgcgctggcccgcaccgtcgaatatttccgcatcccgcgcaccgtgctcaccgtctgcctcggcaagtcgacctatgcgcgctgcgggatcatcgtcaacgtgacgccgttcgaacccgagtgggaaggctacgtcacgctggaattctcgaacaccacgccgttgcccgcgaagatctacgcgaacgaaggcgtcgcgcaggtgctcttcttcgaaagcgacgaagtgtgcgacgtgtcgtacgcggatcgcggcggcagtatcaggggcagcgcggtgtcacgctgccgaaaacctgatctggttgcataacgtctcaccagtttccgggtgaccgctgcgcgtgacgcgccgcggtcgttcttttggagaatcgcccatgaagtttcgtttcccgtcgtcatcatcgacgaagatttccgcccgagaacatctcgggctccggcatccgggcgttggccgaagcgatcgagaaggagggcgtcgaagtcctcggcctcacgagctacggcgatctgacgtcgttcgcgcagcagtcgagccgcgcgtcgtgcttcatcctgtcgatcgacgacgacgaactcatgctcggcgaaaccggcccggacggcgaactgcccgaactcgcgaccgcgatcatcgagctgcgcgcgttcgtcaccgaagtgcgccgccgcaacgcggacatcccgatcttcctgtacggcgaaacgcgcacgtcgcgccacctgccgaacgacatcctgcgcgagctgcacggcttcatccacatgttcgaggacacgccggagttcgtcgcgcgccacatcatccgcgaggcgaaggtctatctcgactcgctcgcgccgccgttcttcaaggaactggtgaagtacgcggacgaaggctcgtactcgtggcactgcccgggccactcgggcggcgtcgcgttcctgaagaacccgctcggccagatgttccaccagttcttcggcgagaacatgctgcgcgccgacgtctgcaacgcggtggacgaactcggccagctgctcgaccacacgggcccggtcgccgcgtccgagcgcaatgcggcgcgcatcttcagcgcggaccacctgttcttcgtgaccaacggcacgtcgacgtcgaacaagatcgtctggcacgcgacggtcgcgcccggcgacatcgtgctggtcgaccgcaactgccacaagtcgatcctgcacgcgatcacgatgacgggcgcgattccggtgttcctcacgccgacgcgcaaccacttcggcatcatcgggccgatcccgcgcgacgagttcaagccggagaacatccgcaagaagatcgaggcgaacccgttcgcgcgcgaggcgatgcgccagaacccgacatgaagccgcgcatcctgacgatcacgcagagcacgtacgacggcgtcgtctacaacgtcgagatgatcaaggacctgctcggcgacctgctcgacacgctgcacttcgacgaagcgtggctgccgcacgcgacgttccacgacttctatcgcgacatgcacgcgatcggcgacggccgtccgcgcacgggcgcgctggttttcgcgacgcactcgacgcacaagctgctcgcgggcatctcgcaggcatcgcagatcgtcgtgcaggattcggagaaccgcacgttcgacaagcaccgcttcaacgaggcgtacctgatgcacacgtcgacgagcccgcagtacgcgatcatcgcgtcgtgcgacgtcgcggccgcgatgatggagccgccgggcggcaccgcgctcgtcgaggaatcgatcgccgaggcgatcgatttccgccgcgcgatgcgcaaggtcgacgccgaatacggcgacgactggttcttcagcgtgtggggcccggacgagctgtcggcagaaggcatcggttcgcgcgacgactggatgctgaagccgaacgaccactggcacggcttcggcccgctggcggaaggcttcaacatgctcgacccgatcaaggcgacgatcatcacgccggggctcgacgtcgacggcgagttcggcgagaccggcattcccgccgcgatcgtcacgaagtacctggccgagcacgggatcatcgtcgagaagaccggcctgtactcgttcttcatcatgttcacgatcggcatcacgaagggccgctggaactcgatggtgaccgagctgcagcagttcaaggacgactacgacaacaaccagccgctgtggcgcgtgctgccggaattcgtcgcgcagcatccgcgctacgagcgtgtcggcctgcgcgacctgtgcacgcagatccacgacgtgtaccgcgcgaacgacatcgcccgcctgacgaccgagatgtacctgtcggacatggaaccggcgatgaagccgtcggacgcgttcgcgaagctcgcgcaccgcaagatcgaccgcgtgccgctcgacgagctcgaaggccgcgtgacgagcatcctgctcacgccgtacccgccgggcattccgctgctgattccgggcgagcgcttcaacaagacgatcgtgaactacctgcggttcgcgcgcgacttcaacgagcgcttcccgggcttccacaccgacatccacggcctcgtcgcggaagaggtgaacggccgcgtcgagtacttcgtcgactgcgtgcgcgactgatggcgacgcacggacgaatccaggcgatgcgtgcggcggtggccgcgctcgtcgtctgggcggcaggcgcgtcggggctggcgggcatgggtgtcgcgcacgcggaagtcgcggcggccgacccgatcgacgtcgcgatgcggcaatgcctcgcgcggcgcgaccggtcttcgccggccggccagatccagtgcatgggcgaagcgcagcagcagtggcaggccgtgatggacggcgcgtaccagcgcctgttgaaggatgcgccggccgacgcgaagcgcggctggcaggacagccagcgccgctggctcacgtggcgcaaggatgaagtgcatctgctgaaggccgtgtacgacaccacgcgcggcacgtcgtacgcgatgtcgagtgccgacctgcagctgcagcccgtgcgcgatcgcgcgctggcgctgcgcggcgcggccgatcgctatgcaccgccgcccgccgccgtgccggtggcggccacgagcggcgcgcagggcggcacgagcgcggcccagggtggggcccggccgaacggcaagccggcgaacgcgctgcgcgatccggccgtgcgccgcgtgcgcccgtgcgaacaggacgccgcgtgcgagcacgcgctgttcgacctgaaccgctattaccagaagctgcgccgcaagatgcctgcgcattcggccgcgacgctcgtacgcgcgcagcgcgcgtgggtcgggttccgcgatgcgacggcgccgctcgtcggcgaggacggccgcgtcgacctgatcggcgcgcgcatcgcgacgatgaaacggctgtcggagacggcgggcaacaagtaagcgcaaccgcgatgccggttgttcggcgatagggcaaaacgggcaccttcgggtgcccgttttgcatcgggtggcacgcgatctaagcgggccgtcgcgtatcgtgcccgccgaaccacgacggcacgagcgcgagcgcatcgtcgagcgaggcgagcacgtgcaggctcagcgcgacgatctcgggcgtcggcgccttcaggtcgggcaccgtgacgaccgatgcgcccgcgccggcggccgactgcgcaccgaaatcgctgtcctcgaacgcgacgcatgcgtgtgccggcacgccgaggcgttcggccgcgagccggtagacggccggatcgggcttgccgcgcgcgacttcgtcgccgcccgcgatcgcgcggaagaacggcagcacgccgaccgcgtcgagccgcgcgcggatcacctcgctcgcggatgacgacgcgaccgcgcacggaatgccggcttgcgcgagcgcgtcgagcagcgcgaacgcgccgggcttcagcggaaacttcggatgcggttcgggcgccgcgagctgctcgcgcacgcgggtgcgcaccgcgtcgaacgtgtcggggttgccgatcagccgcgccaggatcacctggccttcggcgaacgagcggccgacgatctgcaggtagtcggcggtggtcagcgtgacgccgtgcgcattcgacacgtcgatccacgtgttcatgatggtccgctcggaatcgacgagcaggccgtccatgtcgaagagcgcggcggaaaaggtcatcggcggcattcgggaagcggggaaggcgatgggcggcgcgacggccgcccgaatgaaaaacggacgccgatggcgtccgtccggaacagcgggcttaccggccgagcgcggcgcgggctgccttgaccgccgcacgcacctggtcgggcgcggtgccgcccgggtgattgcggctggcgaccgaaccttcgagcgtcaggtagccgaacacgtcttcgccgatcaggtgcgcgacgttcggcagttcctgcttcatctcgtcgagcgtcaggtcggccaggtcgatgccacggtcgtcgcagatcttcacggcgtgcgcgacggcttcgtgcgcatcgcggaacggcaggccgcgcttcaccaggtagtcggcgaggtcggtggcggtcgagaagccctgcagggcggccgcgcgcatcgcgtccggcttcacggtgatgccggccaccatctcggcgaagatccgcagcgtgtcggcgacggtgtcgaccgtgtcgaacagcggttccttgtcttcctggttgtccttgttgtacgcgagcggctggcctttcatcagcgtcagcagcgccatcaggtggccgtttacgcggcccgtcttgcgcgcgcgagctcgggcacgtcggggttcttcttctgcggcatgatcgagctgccggtgcagaagcggtcggcgatgtcgatgaagccgacgcgcgggctcatccacagcacgagttcttcggagaagcgcgacacgtgcgtcatcacgagcgcggaagccgccgtgaattcgatcgcgaagtcgcgatccgacaccgcgtcgagcgagttcgcgcagatgccgtcgaagccgagcgtcttcgccacggcgtgacggtcgatcgggtagctcgtgccggcgagcgcggccgcgccgagcggcaggcggttcacgcgggtgcggcagtcgcgcatgcgctccgcgtcgcgcgagaacatctcgacgtacgcgagcaggtggtggccgaacgtgaccggctgtgcgacctgcaggtgcgtgaagcccggcatgatcgtgtcggcgttctgttccgcgaggtcgagcagcgcgccgcgcaggtcattcagcaggccgccgatgcggtcgatctcgccgcgcagccacaggcgaatgtcggtggcgacctggtcgttgcgcgagcggcccgtgtgcaggcgcttgccggcatcgccgatcagcgcggtcaggcgcgcctcgatgttcaggtggacgtcttccaggtcgagctgccactcgaattcgccgcgctcgatttcacccttgatctgcgccatcccgcgttcgatcgcggccaggtcgtcggcgctgatgatcttctgcgcggcgagcatgttcgcgtgcgcgagcgagccggcgatgtcgacgagcgcgaggcgcttgtcgaaaaacaccgacgacgtgtagcgcttgaccagctccgacatcggttccgagaagcgggccgaccaggcctcgcccttttgtgcagttgggacgtcatggcgattcttcgaaggggatgttgggcggcggcgccgccgagggaatcccgcgattctaacattcgcgggcctgcccgccgcggcgcgcagccgttcgcggcggcccgccggccgtggcccgcgcgggccggcccgttcagtcgcgcacgagcacgaccagcttcaggtcttcgcggtgcgcgggcttcagcgtgatctgctgatacacgaggcgaccgtcggccggatggtcgaattcgcgcaggccgccttcgcgttcgaacacgtcctgcgatgcccagtactgcgcgaaggcgtcgctgccggcggtcagtgcgtcgatcagcgcacgcgtgggcgcgtcggtcaggtgccggatcgaatcggcgcggaattcggccgcgagccgccgcgcgcgggtttcccagtcgacgatcagcgtgcgcgcggccggcgacatgaacgtgaagcgcagcaggttgcggtcgtgttcgccgtcgagccagccggaaaagagcgcggcggccggtgcgttccacgcgagtgcgttccattgccggtcgagcacgtaggcgggcgtcgcgatggccgcgacggtcgcggcgagcgtcggcggcaggtcgccgcccgcgacgtcgggctcggccgggtcgcgctgcgcggccagctcgaacaggtacgcgcgctcggccttcgacagttgcagcgcgacggcgatccgcgcgagtgcgtcggccgacgcggacacggggcggccctgttcgatccacgtgtaccaggtggggctgacgccgcagagctgcgcgacttcctcgcgccgcagccccggcgtgcggcggcgcgggccgggcggcaggccgacggcctgcggcgacagccgctcgcggtgggcgcggatgaattcgccgagcgcacgggcgggcgtggcgtcgagcggcgggacggggacggaggacggctggttcatgcggaaacggcgaagtggaagcggggatgcggcaacgatcagacgggtgtatcgaataccagaataactgcttaacttgtactggtacaggcgcgggcctattgtagcggctcgcgcgctgccagggagcgggcgtcccacaaaacgtgttgcatggggccggaaagtgcactgacgcatccacgccggccgattgcgcaagagaaaggagagaacgatgaaacaccacgaccaggtcgccgacgcattcggcacgacggccgccgcctacctgacgagcacggtccacgcgacgggcgccgacctgcagacgctcgccgacgcggtgcgtgcgacgcccgatgccgcggtgctcgatctcggctgcggcgccggccacgcgagcttcgcggtcgcgccgcacgtgcgcgacgtggtcgcctacgatctcgccgcgcagatgctcgcgacggtcgacgccgcggcgcgcgagcgcgggctcgcgaacatccgtacgcagcagggcccggccgagaaactgccgttcgagacggcgacgttcgactgggtcgtgagccggatgagcgcgcaccactggcacgacatgcgcgcggcgctcgccgaagtgcgccgcgtgttgaagccgggcggccgcgtgctgatggtcgacatcgccggcaacgaccatccgctcctcgatacgtacctgcaggccgcggaagtgctgcgcgacgcgtcgcacgtgcgcgactaccgcgcggacgaatggctcgcgatgttccgcgatgccggcttcgacgcgcacgtgcacagccgctggcggctgccgatcgatttcgatacgtgggttgcgcgcatccgcacgccggccgacagcgtgaccggcattcgcgcgctgtggacgcatgcgcccgacgaggtgcgcggctattacgcggtgcagcccgacggatcgttcgagcacgacgcgctgctgatcgacgcgcactgagcgtgcggtgcgccggcacggtttcgtcgacgcccgcaagcatgaaaaagccgcgatacgccaccgtgcatacggtgggtatcgcggctttcacgtcaccggccggcgcggcatcacgccgcgccgcatgcggatcagcccgtgttgcgcaggccggccgcgatcccgttgatcgtcaggtgaatcccgcggcgcagccgcgcgttcgtgtcgcccgcgcggtggcgcttgatcagctcgacctgcaggtggttcagcggatcgagatacgggaagcggttcttgatcgagcgcgcgagcagcgggttggtcgcgaggcggccttcgtgcccggtgatttccgccagcgcctgcgacgtgcgctcccattccgcgacgatccgctcgaacacgtgcttgcgcagcttgcggtcggcgaccagttgcgcgtagcgcgacgcgaccgcgaggtcggtcttcgccagcaccatgtccatgttcgacatcaggttcgagaagaacggccaggtcttgttcatcttcttcagcagcgcgacgcgcttcgtgcgctcggcttcatcctgcgcgccgtcgagatatgcactcaccgcgctgccgaagccgtaccagcccgtcagcagcagccggcactggccccacgagaagccccacggaatcgcgcgcaggtcctcgatcttgcgctgcttcggatcctgcagcttgcgcgaggccgggcggctgccgatgttcagctcggcgatctcggtgatcggcgtcgacgagaagaaatagtcggtgaagcccggggtttcgtagacgagcgcgcggtacgcggccatcgccgaatcggacagcgtctgcatcgcggcctcgaacgccggcaactgcgcgggcgcgttgttctgcggcaggagcgtcgcctcgagcgtcgcggcgacgaccgtctcgaggttccggcggccgatctccgggttcgcgaacttgctcgcgatcacctcgccctgttcggtcaggcggatctggccgttcacggtgcccggcggctgcgacaggatcgcctggtaggtcgggccgccgccgcggccgaccgtgccgccgcggccgtggaacagccgcagcgtgatcttgcggtcgcggaacaggtcgacgagcgcgagttccgcgcgatacagctcccagttcgacgtgaggaagccgccgtccttgttgctgtccgaatagccgagcatcacttcctgctcggcgccctggtgcgcgatcagcgcgtcgatgcccggcagcgcgaagtattcgcgcatgatgcgcgcggcgtcgcgcaggtcgggaatcgtctcgaacagcgggatcaccatcaggctgttgcgcgcgttgccgccgggcacgccgagcgcgccttcgagcaggcccgtttccttctggagcagcagcacctcgacgaggtcgctgacggtttccgtatgcgaaatgatgtagttgcgcaccgcgcgcgggccgaattgggcgcgcacgtcgcgcgccttctcgaacacgccgagttcgctctgggcgagcgcggagtattcgaggtacggcgagcgcagcggacgcggatcggcgagcgcggcgagcagcacgcgcagcttgtcttcctcggcgagcgccgcgtagtcggcctcgacgcccgcgcgcgcgaacagctcggcgaccacggcttcgtggatgtcggagctctggcgcaggtcgatgctcgcgagatggaagccgaacacttcggccgcgcgcacgagcggcgcgaggcgcggtgcggcgagcgacgtgccgtggtgttcgtcgagcgatgcggtcagcaccttcaggtcggcgacgaacgcttcggaatccgcatacgggatcgcgcgcacgggcggtgcgccgcggcccgcgctgcgcacgggcaccgtgccttcgccgagacgcacgcgcgcgcttgcggcgagccgcgtgtagatgccgatcagcgcgcgacgatacggctcgtcgacgcggtgcggcgactggtcgggcgacgcggccgcgagcgccttcacggcgtcgttcgcgccgacgagcaggttcgacacggacagttcggcgccgagcttgtgcacctgttccagatagtgctcgaggatcaccgcggcctggcggttgatcgcttcgtcgagcgtcgacgcggtcacgttcgggttgccgtcgcggtcgccgccgatccagctgcccatctggaagaacgcgggtacgcgcgcggacaagccgtgctcggcgagcgcggcctcgatgtcgccgtacagcgccggcagttcgtcgaggaacgtcgcgcggtagtacgacagcgcgttttcgatttcgtcgccgaccgtcaggcgcgcgtcgcgcagcatgcgggtctgccacagcgtggtgacgcgtgcgcgcagcatcgattcgttgtactggcgctcgcggctggtcagctcctggtcgcgctcggcgagcaggcgcgcgatgtcgtgctgcgcgtcgaggatgctcttgcgctgcacttcggtcgggtgcgcggtcagcaccggcacgatcagcgcatcgtcgaagaagcgctgcagcagtcgcttcgacgcgttgccggtcgttttcagctgctcgagtgcgtacgcgacggtgccgggctgcgacgcggagccggccagcgcgtggatgcggcggcggcggttgtggtggcggtcttccgcgatgttcgcgaggtgcgagaaatagctgaacgcgcgcacgacgctcaccgtctgctccggcgtcagcttgcgcagcttcttctcgagcgtctgcgcggcttcgctgtcgtcctcgcggcggaacttgacggcggtctggcggatcgtctcgacgacgtcgaacacggtgtcgccttcctgctcgcgcacgacgtcgccgagcaggcggccgagaaagcggatgtcgtcgaacagcgggccgtccttgtcgtcgcgcgtgcgggtgccggccttcgtcgcaccggccgtgcgggcggccgggccggcggctttcgccgtgcgttttgtctgacgtatcgggtctttcggtttcgttgccgttttcgcacggccgttcgcggcggtggcgacggtgtccgtcgaggcgtcggaggaggacagggcagcattgcggcgcgccgtacgcgccgatccggaagacttcacgatgggtttccttgggaaagctcgagtcaaaaggaactgcggaaactgcgaaactgcggtcaagcaaccagctacgtgcggcacatccgcacatcggcgccgcgacccgcccggcggcaggccggacgcaggctccgggcccgggcgggcgggggcgtgcgtgctaccattgttcgatcttcaatcccgtccttcgatgttccagcaatgaattccgagactcctgcggccgggccgcaacaggcacagccgcccgcgacgttgacgattgcttcgcgcgagagccgcctggcgatgtggcaagccgaacatgtgcgtgatgcgctgcgcaaattatatccagcttgtgacgtgaaaatcctcggaatgacgacgcgcggcgaccagattctcgatcgcacgctgtcgaaggtcggcggcaagggcctgttcgtgaaggaactggaggccgcgctggccgacggccgcgccgatctcgccgtgcattcgctgaaggacgtgccgatggcgctgccggaaggcttctcgcttgccgcgatcatggagcgcgaggacccgcgcgatgcgttcgtgtcgaacgactacgcgtcgctcgacgcgctgccggccggcgccgtggtcggtacgtcgagcctgcgccgcgaggcgatgctgcgctcgcgctacccgcacctggacgtgctgccgctgcgcggcaacctcgacacgcgcctggcgaagctcgatcgcggcgattacgcggcgatcatcctggcggccgccggcctgaagcgcctcggcctcgaagcgcggatccgcgcgctgctcgacgtcgacgcgagcccgcccgctgcgggccagggcgcgctcggcatcgagatcgcgtcgcaccgcgacgacgtcgccgcgtggctcgcaccgctgcacgacccgcagaccgcgctcgcggtcgaggccgagcggatggtgtctcgcgcgctcggcggcagctgcgaggtgccgctcgccgcgcatgcggtgtggcgcgcgggcgagctgtacctgacgggccgcgtgtcgacgaccgacggcaagcgcgtgctgaccgccgaggagtgcggggccgtcatgagcgtcgccgatgcgctcgcgctcggccgcgccgtgtccgacgaactcgaggcgcaaggcgcgctcgagatcgtccaggcgctgctcgcgggctcgcaggccgccggcaagggcgacgcctgatggcgggcggcgcgcgcgcgttcaccgctgtcctgacgcgcccgggcggccagtccggcgcgctcgcgtcgcaactggccgaggccggttgcgacgtgctcgaattcccgttgatcgatattgcgcccgtcgacgatccggcgccgctcgacgccgcgttcgcggcgctcgccgattacgcgctggtgattttcgtgtcgccgaacgcgatcgaccgcgcgctcgcgcagtacggcgcgatctggccgaacgcgctgccggtcggcgtggtcgggcccggcagcgtcgcggcgctcgagcgtcacggcatcgcggcgcccgcgcatcgcgtgatcgcgccgcgggcgccggccgacggcggcgtaccccattacgattcggaaagcctgttcgcgtgcatcgaggccgaattcggcggcgcacccgcgctggcgggcaagcgcgtgctgatcgtacgcggcgacggcgggcgcgaatggctcgccgaccggctgcgcgaggccggcgcggacgtcacgctcgtcgccgcgtaccggcgcgtcgtgcccgagccgcgcgtcggtgcgtgggagcgcgtgcatgcgctgctcgacggcgaaccgcatgcgtggctcgtcacgagctcggaaggcgtgcgcaacctgcacgaactcgcgcggacgcatctgaacgatgccgagatcgccgcgctgaagcatgtgccgctcgtcacgccgcatccgcgaatcgagcagaccgcgcgcgcattgggttttgataggattacgctgaccggcgcgggcgatgagcgcatcgtccgcgcgtttcgaacgatggccgacgaggccgtccaaccggcgacagccgcaccggtgactaaacgcatgacagataccaacgattccaaaagcgtcgcttcccagccggccgctgcatccgcaccgccgtcccgtcccgcctatatggcgtccgaaccgcccgcgcgccgcggcggcagcgcggtgctgtggttcgtcgtcgtcgtgctcggctgcgcggcgggcgtcggcggctacgcgctgaaccgcaagatcgaccggctcgacggcacgttcgtcgcgcgccagaaggcgctcgacgcgcagacggccgaaacgcggatgaagaccgagcaggcgctggcgagtacgcaccaggtcgacacgcagctcgcgcagctcgacggcaagctcgccgacgcgcagagcgcgcagcaggcgctgcagcagcaataccaggacctgtcgcgcaaccgcgatgcgtggatgctcgaggaagtcgaccagatgctgtcgagcgcgagccagcagcttcagttgaccggcaacacgcagctcgcgctgatcgcgctgcagaatgccgacgcacgcctcgccacctcgcagagcgcgcaggccgtcacggtgcgcaaggcgctcgcgctggacatcgagaagctgaaggccgcaccggcggccgacctcacgggcctcgcgatcaagctcgacgacgcgatcgcgaagatcgacgcgctgccgctgtccggcgaggcgatcgtcccgcacgaagcgccgaaggccgcgccggccgtggctgcatcgtcggccgtggccggcgagccgcgctggaaggtgtggtggcacgacttctcggccggcctcggccagcagctgaaggggctcgtgcaggtgcgccggatcgacaacgcggacgcgatgctcgcgtcgcccgaccagggttacttcgtgcgcgagaacgtgaagctgcgcctgctgaccgcgcggctgtcgctgctcgcgcgcaacgacggcgcgatgaaggccgacctgcacgccgcgcaggcgtcgctcgggaagtatttcgaccaggcatcgaaggacacgcagaccgtcgaggatctgctcaagcaggttgacggcgcatcgctgacggtcgcggtgccgaacctgaacacgagcctgaacgccgttcagcagttcaagagccggggtaacgatgacgcttcgaggaatcgtctggctcgcggtcctgttcgcgatcgccgctgcgctcgccaccgtcggccgtttcgacgcggggcaggtgctgctcgtctatccgccgtaccggatcgacgtgtcgctgaacctgttcgtgatcgccatcgtcgtgctgttcatcgtcgtgtatgcgctgctgcgcatcgtgcgcaacatctggcgcatgccgcagcgggtcgccgcgtatcgcgcgcgttcgcgcaacgagaaggcgcaggcatcgctgcgcgacgcgatcgcgaacctgtacgcgggccgcttctcgcgcgcggagaaggccgcgcgtgaagcgctgtcggtcgacgcgaaccagggcgcggcgagtctcgtcgcggcgactgccgcgcaccggatgcacgagtacacgcgtcgcgacgactggctgtcgaaggtcgacgcacccgaatggcaggacgcacggctgctcgccgcggccgacatgcgcgcggacgcgcgcgatgccgacggcgcgctcgccgcgctggccgacctgcaggcgggcggcaagcgtatccatgcgcagcaggttgcgctgcgcgcgcagcagcagctgaaaaactgggccgaggtgctgaagctagcgaaggcgctcgagaagcgcgaggcgctgcatccggccgcggccgtgcggctgcgccagcaggctgcggaaaacctgctgcgcgaacgccggcacgacccggacgcgctgctcgaggtgtggcagtcgctgtcgccggtcgagcgccagtcgccgcgtctcgccgatctcgcggccgatcttctcgttccgctcgagcgccgcaacgaagcgcgccgcatcgtcgaggacgcgcttgctcacaactgggatgcgcgcctgctgcgccgttacccggatacggccggcgccgatgcgctaccgctgatccagaaggccgaagggtggaagaaggatcacccggaggatgccgacctgctgttcgcgctcggccgcctgtgccagcagcagcagctgtggggcaaggcgcagtcgttcctcgaatcggcgctgaagctcgccgacaacgaggcgctgaaggtgcgtgcgcatcgtgcgctcgcgcgcctgttcgagcatctcggcgaaaccgacaaggccgcgaagcactaccgcgaaagcgcgctcgcgatcaccgtagtctgacgcgggcggcgtggccgcctgcggcaggcggcccgcgcaacccgcgcaagaaagccccgaatgccggaaggccttcggggctttttcgtccagggcgggcctggacgacacgtcatgcgccgagcttgcgcagcaggtcgtcctcgctggcgacgaaccacaccgattgcccgcgattcgattcgcgcacgagtgcgcggaacgcttcgctgcgggtgagccagcgctcgatgtcgccgaccacgccgagcctgacgccgtagttgacgagcttctgcaggacggcgcccgcgaggccgctttcgagccgatagaagtcgtcgtgcagcgcgtccgcgggcaccgcgatccagtcggcttcgtgctcgtgcgcgagggcgacgaggtcgagcgcatcgctttcccgctgcacgacggcggcggagggatcacggaccagcacgcggcggccggctgcctgaacgattcggtggggcatgtcgatggtttccgtcgacgcgagaaacgcgagtacggtgtcgcgttgcccgcggatgaagtggggctgctcgggaagaaacaggatctgcgcgtgcggcacgagacgcgtcaggcgctcacgcgtgtcgcgcgagtcgagcatcacgtcgcggccgccgacgatcgccagcgtgggcaccgacagcgtgcgcagcacgttgtcggcgaacaccggaatcggttcgatgcgcgggcgaaacccgcgatcgacggcgtgcatcagcgcgagcgcgtcacgctcggccgccgtcgacgcgggcggcaggcggccgagcacgcgccgtcgcacgcatgcgcgcccggcatcgccgagcagcaacagcggcagcgcccaccatagaaaccgcttctgccggccgatgccggacgggcagagcagcgcgagccgcgtcacgcgtgccggccgccgcaacgtgaagtcgagcgccgttcgcgccccgagcgagatgccgacgaacgcggcacgtgacacctgcaggccgtccagcacgtcgtcgagccactgcgcatgcgcgtcgcccgcaagcggcagtcgcgacggcgcgctcggtcctgcttcgccgatcacgtcgatcgcatggagccggaagtgtgtcgaccattgcgccgcgtaatgctgccagctcgccgccgtcgtctgcgcgccgtggatcagcacgaccggcggcgcgtgctcggggccgcaggtgatcacgtgcgtcgcgccatggcgcgtctgcaccgtgacgcgccgatgcccggccggccagtgcgacagcgcagcgtcgtaagccgcgcgaatggcgcgtgcatggcgcggcgacctgaagatcgcgctcatgtcccgctttgctgcagcagcgcctcgagcgacgacatcagcacggccgtgtcggccggcgtcgcggcgacgatgatcttgacctggctcgcggcgggatcgaacgtgacgtcgatccgcacggggtcgacgtacgacgtacggccggacgccatcgcatgcagcgatcgcgacaggtactggtgcagcgactgcgacgcgtccggaatgtcgacgatgctggtgacgcgcaccgcacgcggcacgggcgcgggcggctcggtttgcgcgaacgcggcgaggtcggtgtcgaggatgcggtaggcgcggccgacccgcgtcgcacgcagcttgccctcgcggatgaagcgcaggacggtcttcgggtggaggcgcaggcgggcggcggactcgtcgacggtatggaacatgatcggctcgtgatgctcaatatactccctattgttccatgaaattaggatcgttagggagtattgtggagattatggcatcagcactggcgggatgccgagccggcatcgtccgggcggcacgcatgtggaagcagaaacgccctgctggccggagcggttccggccagcggggcgtttccgggcggatcgtccgccggcagggggcgccgatgcgccccgcgtcatttgtcgaccagccgcttcggcaccgacagcgcgagcagcccgccgagcacgaggaacccggcgagcatgtacatgcccgaatcgttggcgcccgtcacttgcttgagccagcccatcaggtacgggctcaggaagccggcgaggttgccgatcgagttgatcatcgcgatgccggccgcggccgccgtgccgccgaggaatgcggtcggcaggctccagaacagcggcagcgtggtcaggatgccgatcgtcgcgagcgtgaggccgagcatcgcgagcgcggtctggtgcgcccagaccaccgacagcacgagcccgagcgcgccgatcgcggccggaatcgcgacgtgccagcggcgttcgcggtgccggtccgcgctgcgcgcgatcaggatcatcgcgaccaccgcggctgcatacggaatcgccgacagcaggccgatcatgaacgtgtcggtcacgccggtggccttgatgatcgtcggcagccagaagccgacgccgtagagccccatcacgaacgagaaatagatcagcgccatcagccacacgcgcgggctcgacatcacggtgccgagcggcaggtcttccttggtcgcttcctccgcgtcgacgttgcgggtgagcagcgccttttcctcgtcggtcagccacttcgccttcgagatccgctcgtcgagcgagaagaacacgagcacgccggcgagcaccgacgggatgccttcgagcaggaacagccattgccagccgtgccagccgctcacgccgtcgaacgccttcaggatgaagcccgagatcggcccgccgatcacgccggacaacgcgaccgccgtcatgaagaacgtcgtcatccggccgcgccggtgcgcgggataccagtaggtgaggtagaggatcacgccggggaagaagcctgcctcggcgacgccgagcaggaagcgcatcacgtagaacatcgcgggcgtcgtgacgaacatcgtcaggatcgagatcacgccccacgtcgccatgatgcgggcgatccacacgcgcgcgccgaccttgtgcaggatgatgttgctcggtacttcgaagaggaaatagccgaagaagaagatcccggcgccgagcccgtagacggtgtcgctgagattcaggtcgctcgccatctgcagcttcgcgaagccgacgttcacgcggtcgagatacgcgaccacgtagcacagcagcaggagcggcacgagccgccacgacaccttgcgataggttgcttcctcgaatgcgccggacgagcccggcagcgattgcgtcgatgttgccatgttgtctcctgtccttgtaattggccggagaaggcgtatcggtgcctggtccggagtcgtgcgaagccatgcgcgtgtgccgcggcggttgccggccgcggcacgctgcggcaaggggatacggctagatgcagcgcccgccgtcgacttcgagacagacgcccgtgatgaactcggcctcgtcggatgccaggtacagcgccgcgttcgcgatgtcctgcggcgtcgagaagcggccgagcgggatcgtcgcgaggaagcggctgcggttctcggggtatcctcgcagcccatgaattccgtcatcaacgcggtttcgccgagcacggggttgatgcagttcacgcggatgcggtcggcgccgagttcggccgcgagcgacttgctcgcggtgatcatcgcgcccttcgtgctgttgtaccagacgaggcccggccgcggccgcacgccggccgtcgacgcgacgttcacgaacacgccgccgccccgctcgcggaagtacggaacgaaggtctgcacgcaccagaacaggcttttcatgttgaccgcgtacacgcggtcgaattcggcctccgtcacgtcgagcaccggcttgttgcggtgcgtggtgcccgcgttgttcacgacgatctgcaccgcgtggaaatcgtcgagcgtcgcctgcagcagcgcgtgccagtcgtcctgccgcgacacgtcgccggccaccgcgattgccttgccgcccgcgagcgcgatctcgctcgcgacacgctcggccgccgcgccgttcaggtcgttgacgacgacgttcgcgccttcgcgcgcatatgtcttcgcgatgccttcgccgaaccccgagccgccgcccgtgacgatggccgtcttgccgctcaaccgcatggtgtgtctcctgtggtggatttagtgtcgtcgtgcttcggcatgcggccgcgcgctgccggccgcatgccgcgtcctgcttgccgcgtgttcagccgtgccggatcgcgatcgttttcagcgcggtgaagccgtacagggcctcgaagcctttctcgcggccatgccccgaatggccgacaccgccgaacggcagctcgacgccgccgcccgcgccatagttgttgatgaatacctggcccgcccgcaggcgccgcgcgatacgcatctggcgtgcgccgtcgcgcgtccagatgcccgcgacgaggccgtacggcgtgccgttcgccagcgcgacggcttcgtcttcgtcgacgaaacgcatcgcggcgagcacggggccgaacacttcctcctgcgcgagccggtgcgacggcggcacgtcgcgcaacagcgcgggtgcctggtagaagccgctttcgggtgcctcggcgacgacctgcccatgcgcggccatcggaatgccgtcgtgctgcgcgtcggacaggaaatcccacacgcgctgctgctgcttcgcgttgatcagcgggccgcagtcgaggtcggcgcggctcgggccgacacgcaggccgttgaacgcggtggcgagccgctcgacgagcggctcgtacaccgcgcgctcgatcagcacgcggctgccggccgagcaggtctgcccgccgttctgcacgatcgccgacacgagcacgggcagcgccgcctcgaggtcggcatcggcgaacacgatctgcggcgacttgccgccgagttcgagcgtgacgggtacgtggttctcggccgccatctgcgtgaccagcttgccggtggccggggagcccgtgaacgagatgtggtcgatgccgggatggcgcgcgagcgcggcgccggcctcatggccgtagccggtgacgatgttgagcgcgccggccggcagcccggcctcggcggccagctcggcgacgcgcagcaacgacaggcatgcatcctcggccggcttgacgacgcatgcgttgccggccgcgagcgcggcgccgacgctgcgcccgaaaatctgcatcgggtagttccacggcacgatgtggcccgtgacgccgtgcggctcgcgcaccgtcagcacggtgtagccggcttgatagggaagggtttcgccgtgcagcttgtcggccgcgcctgcgtagaactcgaagtagcgcgcgagcgcggcggcatccgcgcgtgcctgcttgagcggcttgccggtgtcgcgtgcctcgatcgtggcgagttcctcgagggaatcggccacgcgcgccgacagccgcatcagcacgcggccgcgctcggcggcgctttggcgccccatgggcccgcgaacgcgtcgcgggccgcggcgaccgcacgctcgatgtcgggcgccgtgccgcgggcaatggctgcgaacggctggccgtcggacggatcgacgaccgcgatggtttccagttgcgcaggcaacgtccattcgcctgcgatgaagtgcttcgcctcttccatgcgtgctcctgtcttcgcgccgaccgccgacggtgctccggcgccgacgccgattccatgcaacgcggccggtggttcgacggccggacatcgggaacgattatcgcgccgatcgtcatccggacgccaccggtcgattggctataatggcgcattccgttggggacgcctgcggcgatgcatcggccgcggcgccctgtcccgaattcccatcgacctacagagagtgctcatgagcttcaaccatgttccggccggcaaggacctgccgcaagatttcaacgtgatcatcgagattcccgcgcaaagcgacccggtgaagtacgaggcggacaaggaactgggcctcctcgtcgtcgaccgtttcatcggcacgggcatgcgctatccggtgaactacggctacatcccgcagacgctgtcgggcgacggcgatccggtcgacgtgctggtgatcacgccgttcccgctgctggccggctcgatcgtgcgttcgcgcgtgctcggcatgctgcagatgaccgacgagtcgggcgtcgacgcgaagctggtcgcggtgccgcacgacaaggtctgcccgatgacggccaacctgaagtcgatcgacgacgtgcccgagtacctgaaggaccagatcaagcacttcttcgagcaatacaaggcgctcgagaagggcaagtgggtgaaggtcgaaggctgggccggcatcgaagccgcgcacaaggaaatcgccgacggcgcagcgaactacaagaagtaagccggctggccggcctcgcggccggttcgttcggaacgcaaaccgcgcgtgtctcgtcaggaggccgcgcggttttgttttgtgcgcggaccggcgcccggggtggccttctttcggggcgcgcgggggccggcgcaggcagggcggtcgcgttcgatgcgcttctcgcacgattcgcgcgcgtggcgcggcgggtggcggtgacgggattcgccggggtttcgaccgtgtcggtggtggtctttgttgccgatgcacggcggcgcgccggcgcggcagcaacgtcggtgcgtggtttggcgacggacttgccgccggctgccggcgctttctgcttcggtgcggctttcgtggccttcgtggccgccttgccgcgagacgagccctttttcacttcggccgcgtcgtcggtcttcgcacgcttcgtggcaggcgtggccttggtcttcttgggcgcctgcgcggcctgtccgcgcttcacggtttttgcgggcacggacgctttcccgtcattcccggccttcgcggctttcttgacgggcttgtccgtttcagcggcctgcgtcgcgatgtcgacagactgcgccttcgccttcttctgcccgcgcttaccggccttcaacccggccgtatcgacgttcccgtcgatcgacatcccggccggcaacaccgactcgagcgtccggatcccggccgccagttcgtgtttctgcgcggccgtgagccgcttcacccagtactcggcacgcgatgcgatcgaccggtcgggcagcggaaacgacgcgagcaccgcgcgcggcttgcgcgagcgcgtgtagcgcgcgcccttgccggacgcgtgctcgtcgaagcgtgcggcgacatcggtcgtgatgcccgtgtagacgctgtcgtcggcgcattcgatcaggtacagaaaccaggacatggcagggcggcgggatgcgaagccgccagtgtctcagaaaaggcgcgcgtcaacgccatcgatcgccgtgcccgtcgcgaaaacggctcggtgccgcgccgagttcgcgcgtgaagaagcgcgtgaacgcgctcgtcgaacggaagccgacgcgcacgccgatctcgccgatcggcagttgcgtattcagcagcaggtcgcgcgcctcgccgagccgcgcctgcgcgacgagcgcatgaaagccgaccgcctcgcgatgcagccgccggcgcagcgtccagcgcgacatcgcgaagcgcgtgcacacgtgctgcatcagcgtgtcggtcggtacatcggcttcgtcggcggtacgcagccagtcgcgcacgcattgctcgaccgacgagccgaacgtcgagcgcacgcgtacacgctcgcgcgcggcgtcggccgcgtgacgctgaatgccggcgagcggcgcgttgtagcgttcgaacggcgtgtcgaagtgcgcggagcgcagcacgatgcggttgtgcgcggcatcgaacgacatcggtgcgccgagcatgtcgcgcagcgcggcggtgggggcgaacgcgcggccggcgaaggcggcgtcgtcgacgcacacgtgcggatcgtacaggcgggcgagcgcggcgaggatcgcgaggttcgcgaacgcgctgcccgcgtgccggccgtcgccttcgttcacgtattcgagcgcgatcgcgtcgccgttctcgtgcgcgaagacccagtcgacgttgccgatcagctcgcgatagtgcaggtagccgtgcagcgcgtcgcgcagtgtcgccgcgttgcacgtgacgcccgcgagttccgggaacggcacgagccacggcacgacctgcggcggcgggcgatgccacgacagcggccatgcgctcgtgagccgcatcgcggcgacgtgccggtcgcccgcgatgcggcgcgcgtcgtcggcaagctcggccggaccgatgccgagcgtgtcgtaaagcggtgcgagatcgatgccgttcgcgcgcgcgtcttcgcacagccagcggtagatccgcacggataccgatttctgttgcaactccatgtctgtccccttcgtcatgccgttcgggtttgtccccgctgcgagaggtcaacgcatgctcctgccggtcaagcgtggtgaccggtcaatttttagactcggacgctggagtgtggcgacaagtacaacagaacgattcaggaggatcaatgaaaacttcgctgttccggtgttcgacgattgcgtccgcgtgcgcgctcacggtgctgctcgcgtcgtgcggcggcgacgacatccacgcgggtccggccgcgccgcccgaccccgatgccgcggccgaccagcgcgcggccgcgctcgtcgcgcaactgacgaccgacgagaaactgcagctcgtgcacggcacggcctgccggcgctcgacctgggcggcccgttcccggccgacgcactcaatggcgcgagctacatcccgggcgtgccgcggctcggcattccggccgtcagcagcgccgattcggcgggcggcgtgaacgtgaagaacgcgcgcgtgaccgcgctgccggcgccggtcgcgctcgcggcgacgtgggacccggcgctcgccggcacctacggcacgcgtatcgcgctcgaactgcgtgcgctcgggttcgcggaagggctcggcggcggcgtgaacctcgcgcgcgagccgcgcaacggccgcacgttcgaatacatgggcgaggatccggtgctggcgggcacgctgagcgccgcgcgcacccaggcgacgcaggcgcagaaggtgatcgcgacgatcaagcatttcgcgttcaacgaccaggaaaccaaccggatgacgatcgattcggtcgtcgacgagcggaccatgcgcgaggccgaactgctcgcgttcgagatcggcgtgaaggatggccagccgggcaacgtgatgtgctcgtacaacaagctgaacggcgtgtacgcgtgcgagaacccgtatctgctgaccacggtgctgaagaacgaatggggcttcaagggcgtcgtgcagtccgactggggcgcgacgcattcgacggtcgcggccgtgcaggcggggctcgacgaggaggagccgggcgcggcggacgacaacaacgcgccgctcggctcgttcttcaacacgaagctgcgtgcggcgctgcaggccggcagcgtgtcggccgcgcggctgaacgacatggtgcagcgcaagctgcgcacgctgatccgcatcggcgtgatggacgcaccgccgaagccgggcggcgcgatcgacgaagcggccggcaacgccgatgcgctcgcgatcgcgcggcaatccgcggtgctgctgaagaacgcggccgcgcccggcgatgcgcagcccgtgctgccgctggcggccggcgcgctgaagtcggtcgtcgtgatcggcgggcatgcggacgcgggcgtgctgtcgggcggcggctcgggcgcggtgccggcgatcgacggcaatgcggtgacgacctgccagcaacccgccgacacgctgttcggcggctgtgcgacgtggtacaagtccgcgccgctcgcggcgatccgcgcgaaggcgccgaacgcggcggtcagctacctcgacggaaccgacgcgaatgccgcggcgagcgcggccgcgcaggccgatgtcgcgatcgtgttcgcgacgcagtggcagacggaagggctcgacctcgcgagcctgtcgctgcccgatgcgaaggccgatccgtacaaccagcaatacgaccagaacgcgctgatcgcggcggtcgcggcgaaggcgaagcgcgtgatcgtcgtgctcgagaacggcagccccgtgctgatgccgtggctcgcgaacgtgcatggcgtgctcgaagcgtggtatcccggcgcgcagggcggccaggcgatcgccgatctgctgttcggcgatgcgaacccgtcgggccggctgccgctgacgttcccgaaacaggaggccgacctgccgcagccggcgatcgatccgtcgcgcacgcagaccgtctacgcggaagggctcgcgtacggctatcgctggttcgacgcgaaggcgatcgagccgctgttcccgttcggctacgggctgtcgtacacgacgtatgcgttgtcggcgatgtctgcgcgggccgatgcggcaggcaacgtgacggtcggcgtgacggtgacgaacaccggcgcgcgggccggcgcgcagacggtgcagatctacgcggcactgcccgcgtcgctcagcgaaccgccgaagcgcctcgtcggctggaccaaggtcgcgctgcagccgggcgaggcgcgtaccgtcagcgttgcggtgccggcgcagcgcttcgcggtgtgggatgcgaatacgcatgcgtggcggatcgctgcgggcagctacgggctgtcggcggcggcttcgtcgcgtgacccgcaggcgcagtcgacgacggtgacgctcgccgcgcactgagccgggcggccacgcggcatgcggcgaggccggtcgtggtctcgccgcattccggtacgtaccggcacgttccggcgcgcagtcgttacccggcgccgcgccggaacggatcgtgttcgcgcaattcgtcgacgtacgcgtggatatgctcggtctcgcgttcgagaaagcgcgcgacggcgtccgagaatgccgggtgcgcgagccagtgcgcggagtgcgtgacggtcggcaggaagccgcgcgcgagcttgtgttcgccctgcgcgccgccttcgaacgtgtcgagcccggcctcgatgcagaattcgagcaactggtagtaggccgtctcgaaatgcaggcacggcacgtgttcgaccgctcccagtagcggccgtacagcgtaccgccgccgttctcgccgcgccggtagacggcgagtgcgctcgcgatcggctggccgccggcttccgcgatcacgagcagcaggttctcgggcatcgtcgcaccgatcgtgcggaagaagtcgaggttcaggtacgggctcgaatagtgttcgcgataggtctgccggtagcagcgcgagaagaagcgccagtcggcgtcggtgatccggtcgccggtcagccgccggaacgtcacgcccgcctcgtgcaccttgcgtcgctccgcgcggatgttcttgcgcttcttctgctcgagcgtgccgaggaaatcgtcgaagtggcggtagccgtcgttgatccagtggaactgcacgccttcgcgcagcatcatgcccatcgattcgaggagcgccgcttcgtcgccggtcgggaacagcacgtgcagcgacgacacgtcgctctgctcggcgaatgcgagcagcgtggccgcgaggcggcggcgcgcatcgtcgtcggccgcgagcaggcgcgtgccctgcacgggcgtgaacggcaccgcgcacagcagcttcgggtagtagggcaggtcgttgcgctggtacgcgtcggcccaggcccagtcgaacacgtattcgccgtaggaatgctgcttcgcgtagacgggcgcggcggccgcgaggcggccggtgcgctcgtcggtcagcgtgacgaaatgcggcgaccagccggtgtcgtcgaccgcgcagcgcgcgacgtgcagcgcgtcgaggaattcgtggcgcaggaagggcgtcggctgcgcgtcgcgggcgagcagtgcgttccattcgtcggccggcacctccgcgggggacgacaggatgcccgtgcgataatcgatgcgttcgtgtttcaagcgtgaatccgtaccgttctgtgtcgccggatgcgagggcctgcgcgggcccgcaccgggacgatttcgtcagccgttcagggcgcgccgccgggctgcgccaatcccgccatgaagacccgactcgctctcgcccagatcaacgtcaccgttggcgatttcgccggcaacgtcgcgcggatcgtcgcggccgcgcgcgccgcgcacaacgatggtgcgcagttgatgatcgcacccgaacttgcgctgtccggctatccgccggaagacctgctgctgcggccggcgttctacgcggcggcggcggccgcgctcgacgcgctcgccggcgccttgaaggcgttcgacgggctcgcggtgctggtcggccatccgttgcgcggcgcgccgggcggcgatccgcatgcgccagccgtcgatggtaatgcaaaccgcccgatcgagcgcggcgtgccgcccaccgatacctacaacgcggtatcgctgatcgtcggcggcgagatcgtcggcacctaccgcaagcaggacctgcccaacaccgaggtgttcgacgagaagcgctacttcgcgacggacgccgagccgctcgtgttcgagctgaacggcgtgaagtacggcgtgatcatctgcgaggatgcgtggcatgcatcggccgcgcagatcgcgaaggcggccggcgcgcaggtgctgctgatcccgaacggctcgccgtaccacatgaacaaggaagcggtgcgcgtcgacatcctgcgcgcgcggattcgcgaaaccgggctgccgatggtgtacgtgaacctcgtcggcggccaggacgaactcgtattcgacggcggctcgttcgtgctcgacgcgcagggcgcgctcgtcgcgaggatgccgcagttcgacgaagggcacgcgatcgtcgaattcgacggcgcgcggccgctgcccggcgcgatcgcgcccgagctgtcgaccgacgcgcaggtgtaccgcgcgctcgtgaccggcgtacgcgactacatcggcaagaacggctttccgggcgtgctgatcgggctgtcgggcggtgtcgattcggcgctggtgctcgcggtcgcatgcgatgcgctcgggcccgggcgcgtgcgcgcggtgatgatgccgtcgcgcttcacggccgacatctcgaccaccgacgcggcggacatggcgcggcgcgtcggcgtgcgctacgacgagatcgcgatcgcgccgatgttcgacgcattccgcgcatcgctcgcgggcgagttcgcgggccgcgcggaagacgcgacggaagagaacatccaggcgcgcatccgcggcacgctgctgatggcgctgtcgaacaagttcggctcgatcgtgctgacgaccggcaacaagagcgagatggcggtcggctactgcacgctgtacggcgacatggccggcggcttcgcggtgatcaaggacatcgcgaagacgctcgtgtaccggctctgccgctatcgcaacgaaacggccgactatgccctgcgcgacgtgatccccgagcggatcctcacgcgcgcgccgtcggccgagctgcgcgagaaccagaccgaccaggacagcctgccgccgtacgacgtactcgacgcgatcatgcggatgtacatggaagaggatcggccgctcgccgagatcgtcgcggccggttatgcgcaggcggacgtcgaacgcgtgacgcggctcatcaagatcaacgaatacaagcgccgccaggcgccgatcggcattcgcgtcacgcatcgcgcattcgggcgcgactggcgctacccgatcacgtcacgttttaccgaacgcctcgactgagccgtgatgagccgcatgcggctcgcaggcttacaatcggggtcgcgatttttcatccaaacgagcattgggggacaaccaccatgaaacgcatcactgccatcatcaagccgttcaagctggacgaagtccgcgaagcgctcgccgaagtgggtctcacgggcctgaccgtgacggaagtgaagggcttcggccgccagaaggggcataccgagctgtatcgcggcgcggaatacgtcgtcgacttcctgccgaagatgaagatcgaggtcgtcgtcgcggaagcgcaggtcgaccaggtgatcgacgccgtgatcggcgcggcgcgcaccggcaagatcggcgacggcaagatcttcgtgtcggatgtcgagcgcgtgatccgcatccgcaccggcgaagagaacgaagcggccgtctgagcgccgtattcgtcagcgggccgtttcaggccccgccaataaaaacggtgcgatacccggttgggtaccgcaccgatacgcgcctctcgcagcagcgtggaaagtgttgccgaatcgttctttgacggcgcctgatcagaacaggtgctggatgccggcgtagacgccggtctggctgccgcccggattcgggttgcccgtcgacacggccgtaccggcgccgttcgcgttcaggccgaagttggcgttcttgctgttgcgcaccgtcgcgacctgcaggtcgaacagcgtgcgcttcgagatgttgtacgagccgccgacggtgtagatgttcgcgttgccgccgccgtggttcgcgttcacgtgatacacggccgcgatcagcgccgctgccggcgttgcctgccacgtcacgccgccccagacctgctgggtgcccgtcacgccggcgttcaccgccgggccgccgctgccgtccgcgcgcgaggcctggtaagcggcctgaaccttgaactggccgaggaacacgttcacgcccgcgaagtattcacgcgagtagttgaacacgtccgagaagcggccgttgctgtcgcgcgtttcgtcgtagatgccgcgcaactggaacagcgaattcgtataggtgacctgtgcgccggctgcacggcccggttggccggccgtcgtgttgccgttgaagctggtcgagttggagaacgagaactggccgtagaagtcgaggccgtagaactgcggcgactggtacgacacgttgttgctggtcttgttccagttgcggccgcgcaccagcgatgccgtcgaccaggccgactggccgaacgggtcgaagtcccacacgccgttggcgatcgcgagttcacgacccagcagcagcgtaccgtagcggtcgttcgagatcccgaccgtcgcataacgatcccagatcgagccgctgaagccgcccgtcatcgtgttgaacgcaccttcgaggtggaacaggatcttgttgccgccgccgatgtcttcggtgcccttcaagccccacaggctggtgccccagtcgccgctttccgcgcgcacctggtggccgttttgcaggccgttcaggtactcgaggccggcatccaggcgaccatacagcgtgacgctgctctgcgcgtgcgccgtcaccaccccagcagccatcagcgcggccgcgaccaaagctttcttcatcatctcctccataccctgtcaaaaagtcaacccagactgcacgagatgcccggagcgcgagcgccgggcaaaagcgggataaccaggagacctcgtgcagggccggtaagcgcagcacgcgggcaagcggacggaaaaccgttgagcggtcccgcgcagccgggtcggcctgcggggtctccttgtagtgtcgtgaagctaaactacatttcacgaacttcgttttgctactttggttactaatttagcaaaaatacaattttgtggcgatggaaatcgttgtttgactaacacctgtcgccaaattgccatgcaacacggtgggcaacaggtgcgccgagggtttgcaattaacggaaaacccttgtcccacaagggagacacggctttcgcaaacatggatcaaggattgccactattgacgttgtaggggcgcgggcgtaagcgccatacaagaggaattggtaagtatttcgtaatgaatgggcgggcaccggacgtcgcctgcccgtgcctgtcgcgctggcacggcaacgcgcgacgcggtgcgccggcgcgctccggtcaggcaggctccggcctcgcttcgagcaactgcgtgcgaatccagcgatgcgcatcggtgcgcgcgtgcttcgcgtgcgagtagaccttcacggtgtagcgcgggatctcgaacggcgctggaaagatgcggatcggcgccgcgtgccgcagcgcctgcgcggcgcggttcggcacggtcatcagcagcgcggattccgcaatcacgaacggcgcggccagcacggtcggcaactgcacggcgacttgccgtgcgaggccgagccggtcgagcacgtggtcgacgacgccgcgcgactcgttccaaggcgtgacgaccacgtggcgtgccgtcaggtactggtcgagcgtgagccgccggcggacgtccggatgcgcggcgctcgcgatgacgacgtagtcgtcggagaaccagtcgaagtcctcgatgcccggcgcgtcggccgccgattcctcgtggtagccgagcgcgaaatcgatgcggccggccgcgagttcgtcgacggaaatcttccggtcggaatgcacgacgcggatccgcaaccgcggcgcgacatgctggatgcgcgcgagaaacgccggcagcaccgcgaatgccgtgtagtcggtcgccgcgaacacgaacgtgcggtcgctttgcgcgggatcgaagcggcgcgcgcgggcaagcccctagacatcgcgtcgagcgcgtcgccggcccaggtggcgatgtcgtcggcgcgcacggtcggctgcatctcgttgccgaggcgcacgaacagggcatcgccgatcgcgtcgcgcaaccgcgcgagcgcgtggctcagcgcggacgggctcaatgcgagctcatgcgcggccgtggcgacggaccggtggcggtacagcgcgtcgaacacgagcagcaggttcaggtcgagacggcgcaggtcgggatgcatcatgttcaggtcgggatgaaaaacctgcacttcctgcaggcgctgcgtgaacgtagcatgacgatctgattggcgccagcgcggctgcgcggcgccgctttccgtttcaagtccgggccggaggagggctcatcccgtgcaaatcgacattcgttccgccaccgtcgccgacgtgccgcagatcctgcgtttcattaccgaactggccgtctacgagaaggcggagcacgaagtggtcgcgacgcccgcgtcgctcgagcgcagcctgttcggcgacggatcgccggcgcgtgcgctgatctgcgaggtcgacggcgagccggccggcttcgccgtgtatttcttctcgtattcgacgtggctcgcccggcaggggctgtatctcgaggacctgtacgtgtcgccgcgttttcgcggcgcgggcgccgggctgcggctgctgaaggcgctcgcgcggatcgcggtcgagtcgggctgcgggcgtttcgagtggagcgtgctcgactggaacgagccggcgatccgcttctacgagagcgtcggcgcggcgccgcagagcgaatgggtgcgttaccggctcgcgggcgacgaactgcgcgcgtttgccggcagcgcgccggtgagcgccgcatgaacgccacgtaaatgccacgtaaacgcaaaacgggcgccgcgaggcgcccgttcgaacgtcgtgcgtttcgtgcgcgttacttgaggctgccggacaggaacccgcgcaggcgttcgctcttcgggttggcaaacacctcggacggcacgccttcttcctcgacgcggccctggtgcaggaacatcacgtggttcgacacgttgcgcgcgaagcccatctcgtgcgtgacgacgatcatcgtgcggccttcctcggcgagcttctgcatcaccttcagcacttcacccaccagttccgggtcgagcgccgacgtcggttcgtcgaacagcatcacgtccggatgcatcgccagcgcgcgcgcaatcgcgacacgctgctgctggccgcccgacaggtgcgacggatactgcttctcgacgcgcggcgcgaggccgactttctcgagatacgcgcgcgcacgttcctcggcttccttcttcgggatgccgagcacgttcacgggcgcttccatcacgttctcgatcacgttcatgtgcgaccagaggttgaaatgctggaacaccatcgacagcttggtgcgcacgcgctgcagctgcttcgtatcggccgcgcgcagcgcgcccgtcttgtcgagcgcggtgcgcacttcctcgccgtcgacgaagatgcggcccgcattcggctgctcgaggaagttgatgcagcggagcatcgtgctcttgccggagccggacgagccgatcacgctgatcacgtcgcccgagttcgccttcagcgacacgcccttgagcacctcgttgtcgccgtatcgcttgtgcagatcgtcgacgaaaagcttctgagtctgggaattcatcaatagtcctgcgaaaacttacttgccttgcgggcgcagatacgcgagccagcgacgctcggcctggcggaacagccacacgagcgtgaacgagatcacgaggtagagcagggcggcgatgccgaacgcatggaacgacatgtaggtcgccgagttcacgtcgcgggcgatcttcaggatgtccggcacggtcgcggtgaaggcgacggtggtcgcgtgcagcatcaggatcacttcgttgctgtacagcggcagcgcacggcgcagtgccgacggcaggatcacgcggcgatacatcgtgaacgtggacatcccgtaggcacgtgcggcttcgatctcgccgtacgacgtcgccttgatcgcgcccgcgaagatctcggtggtgtacgcgcaggtgttcagcgtgaacgcgagcagcgtgcagtgcatcccgtcgcggaagaacgcgtcgagcatcggcgtgccgcgcacggcctgcaggctgtagaggcccgtgtagcagagcagcagctgcacgtagagcggcgtgccgcggaacacgtacgtgtagagccacacggcgcccgacagccacttcttcttcgacacgcgcgcgaccgcgagcggcaccgacaggcagaagccgaggccgatcgacacgaccagcagccacagcgtgatcgcgacgccggtgatgcggtagccgtcggtgtagaggtagttgcgccagtattcttggatgaggtcgatcataggtcagccttgcggacgccggtcgagtagcgcttttcgagccacatcagcacgaagttcgagatcgtcgtgatcgcgaggtagacggcacccgcgatcagcgtgaagaagaagaaccgcagcgtgcccttgccggcgtcctgcgacgccttcacgacatcggccaggccgatgatcgacacgagcgcggtcgacttcacgagcacctgccagttgttgccgatgcccggcagcgcgaagcgcatcatctgcgggaacatgatccgcgtgaacacctgccagctggtcatcccgtacgcgctgccggcctcgagctggccgcgcggcaccgacaggaacgcaccgcggaaggtctcggtgaagtacgcgccgtagatgaagccgagcacgagcacgccggcgaggaacgggtcgatgtcgatctggtcccagccgagcgcgtcggtcgccatgttcagccagatctgcaggctgtagaacagcagcagcatcagcacgaggtcgggcacgccgcggatcagcgtggtgtagacggtgccgacgccgttcgtgaagcggttgcgcgacagcttcgcgcccgcgccgagcagccccagcaggaacgacagcgcaagcgaaagcaccgccagtttgacggtttgccaggtgcccgcgaggatcagcgggccgtaaccttgtagaaacatatgtggtccctggtgtggtccctagtggggtcccgtagggcgcacgcggtgcgccgcgaaagacgcgcccgccaagctgcgcggaacgccccgtgcgtatcatgaccgtccgccccggcatcggtgccgggccagcccgtcgcgcgagcggcgggcgaggggcgggcggcgcgtggtcgactgcctgtactgcccggacacggggccgcccccgcatccgttgcctctttttcgacgctcagcgggccgaagccgaatagacgctgaacgcgaaatacttgtgcgacagccggtcgtacgtgccgtccttgtgcatgtcggccagcgccttgttgatcttgagcttcaggtccgtatcttccttgcgcaggccgatcgcggtgccgtcgccgatcgttttcggatccttcacttccggcccggcgaacgcgaagcccttgccgcgcggcgtgcgcaggaagccgtagtcggcttgcagctcgtcctgcagcgtcgcgtcgaggcggcccgagccgagatcggtatagacctggtcctggttctggtaaggaatgatcgtcacgccctgcggctcccagtacgccttcgcgtaggtttcctgcgtcgagccctgctcgacgcccacgcgcttgcccttcagcgaggcgatcgtcggcagcagcggcgaaccggccttcgcgatcatccgcgccggcgcgtcgtataccttgtcggagaagtcgatctgttcgcggcgcttgtccgtgacggtcagcgacgacacgatgacgtcgtacttcttcgccttcagcgccgggatgatcccgtcgagatcctgcgccacccacacgcatttcacgttgatccgcttgcagatttccttggtgagatcgacgtcgaacccgacgatctcgccgctcggcgcggtcgactcgaacggcgggtagctggcgtcgacgccgatccgcacggtcttccactccttcgcgaaggcgctgcccgccacgagggcgagggcggcgcacagggcggccttcttcatttcgatccttctgttgctgactttccggggcgctcgcggccggtcggaccgggcgccgcggcgtattctagacggccaaaattcgccgatcggcgctctggcgatggcggccgccggaacggcgaacgccaaaagggcggtattttacccgaacgcgatacccggaaaccggcaatccgggccgaccgatcgattcttcgaggcattgatccggctgttgcgataatcgtcgcattcgcagcgggcattgggtcaattgcatccgcagatgcaacgatgcagtgcgcgagcggtggattgtggcgcgattggcacactcatacagtgacggcataccagaacagcgcctctcacggagtgtccgtcccatgttccagatccgccgcgccgccgatcgcgaccagcgcagccatggctggcacgaattccttcacagctttccttgcgcgtccgcccggagcgggccgccggtcttcggcgcgttgcgcgaactgaacgaggaatgcatcgcgccgacccgcggctacgggatgcggccgtaccgggatgcggaaatcgtcacctacgtgctcgacggcgcgctcgcgcaccgcgacagcctcggcaacggggcaatcgtgcgtgcgggcggcgtgcagcgcttgagcgccggcaccggcgtcatgctcagcgaagccaacgcgtcgtgggaccagccgctgcgcctgctgcggatctggctcgcgccggccggggcgggcggccggcccggctacgcgcagacgcgctttgccgacggcgagaagcgcgggcggctgcggctcgtcgcggcgccggacggcggcggcggcgcgctgccgttgggcgcggacgcacgcatctttgcgggactgatcgacggcgacgaggcggcggcgttcgacctgccggccgggcgccgcgcctatgtgcacgtggtgcgcggcgacgtcgcggtgaacggccgcgcgctggccgcgggtgacggcgcgcggatcggcggcgtggacgcggtggcgttcgcacgcggccgggcggccgaggtgctgctgttcgacgtcgcctgaaacgcaaaggggacgcagggcggtgcccgcgtccccttcgaggatgccgctccgcggagcggccccgccggcttactgcgccggtgccgacgcggccttggccgcgcgatgctgctgccagcgctccttcatcttctcgtggcgctgttccatcttcgcgaactgctgcttgagcgccgtgctgaccgtggtcttctgctggtcgttcaggccgttgtagaacgcgagccacgcggcggacgtctgctcgcgcagttgcgcgttctgctgctcggcctgctggcgcgcggcgtgcatcgcgctgagatcgaggatcggctggttctgctgcgccttgaactgctcgcgcatctgctcgtggctcttgcgcatcgcgtcatggttctgcttcatcgtgttgacggcggcctgccactgctgttcctgcgatgcgttgagcttcagctggtcgtgcagtttcatgatcacgccgaacgggccgccgtcgtgcccgccgtgcatctggtgggcgccggggccgcccggaggcggcatgtcgccgggttgcgcggcgtgggcggtgccgaatgcgagagcgagcacggtggcggccgcgatggccacgcgggaagtcttcttatacatttcagaaactccttgtatccaaagggtccggcgatgcggtgccgggaaagccgtgtaccgcatccggtaagacgcaggttagcgaggcaggccccggccgatgttacgtggcgcggtggccgggttaccgcgcattacagttcccttgcgcggtaacccgcagtaaccctttcgtcccattgtttcgttcttcgactccgccctcgcgcggtaaacttcgagccatgactacccagatcctcatcgtcgacgacgaccaagaactccgagacctgctgcgcgactatctcgtgcgccaggggatggaagtgtccgtgctgcacgacgcggcgacgctcgagaaacgcctcgagcgcgagcggcccgacctgatcgtgctggacctgatgatgccgggcgtcgacggcctgaccgcgctgcgccagttgcgcgcggccggcgacgacatccccgtgatcatgctgaccgcgcgggcggacgacgtcgaccgtatcgtcgggctcgagctcggcgcggacgattacctcggcaagccgttcaacccgcgcgagctgctcgcgcgcgtgcaggccgtgctgcgccgccgccgcgcgacgccgtcggcggcggcgcccgagcagcgcgagccgttcggattcggccgcttcgtgctcgacttccaggcgcgtacgctgtcggtcgacggcaagccggccacgctgtcgagcagcgaattcgcgctgctgaagatcttcgtgaaccatgcgctgcgcacgctcacgcgcgagcggctgctcgagctgctgcacgggcccgagtacgacggcaccgaccgcggcatcgacgtccaggtgtggcgcctgcgccgcattctcgaaacggatccgtcgacgccgcgcttcatccagacggtgcgcgggcgcggctacgtgttcgtgcccgacggcgaggcccatgcgcaaacccattgattcactgttcgggcggctggcgctgctcgtcgtgggtgtcctgctcctgtcgcacttcgcgtggtttttcgcgatgcggctcgagcgcagccagatgcagacgcgctacgcggtcgaagaggccgcgttcctggtcgacgcggtgcgccagcacgtcgagcgcacgcccgaccagccgttgccgtcgcgtgtgcggctcgtggcgccggacagcgccgacgtgccgaacggcgatccgtcgagcctgccggcggcgctcaggcggttccgcgacgacgtgagcgagcggatgccgcccggcacgcgcgtcgagctcggcgcacccggccatccgccggtgctgtgggtaaaggagccgaccgaccgcaactggatcgtggtgccggtgcagccgctgcggccgccgcgctcgctcgaccggatgctgctgtggctcggcacgatcttctcggccggcgtgattgccgcgctgttcgcggcctggcagctgcagcagccgttgcgttcgcttgcgcgcgcggtcgcgcgcttcggccgcggccagccggtgccgccgttgcgcgagcgcggcccgcgcgagctgcgccagctcacgcacggcttcaaccagatggtggagcaggtgtcgcaggccgaaagcgaccgtgcggtgatgctggcgggcgtggcgcacgacctgcgcacgccgcttgcgcggatgcggctgcgggcggaaatgatggacgacgtccggctgcgcgacggtgtcgtgcgcgacgtcgattcgatgtcgcacatcgtcgaccagtttctggtgtttgcccacggcgggtccgatcgcagcgagccggtgccggtcgatcaggcgtgcgagcggatcgcacgcagctatcgcgcggtcgcgccgaacgcgccgacggtccagacccggctcgacgccgatccgggcttccgcctgccgacggcgacgctcgaccggatcctgtcgaacctgctggacaacgcgcatgcgtacggtgcgccgcccgtgctcgtcgagacggcacgcacgccggccggctatgtgctgtcggtcagcgacagcggcggcgggatcgccccgcgcgatctcgcggcggcgacgcggccgttcgtgcggctcgatcccgcacgcggcgggaacggccacagcgggctcgggcttgcgatcgtcgagcggctcgtactcaggctgggcggggcgtgcgacatcggcaaccgccccgaaggcggcctgcgtgtcgcgatgacgttcccgttcgaggccgtgccgaaggacgaaccccacgcacaggccgcatgagcggctgcggcgccggcccggccgggctggcgccgcgtggcatcattcgccgaacagcgtgccgagcgtctcggccgcgttgctgtcgatggtgttgtaggtcacgctggtggcctcgaagatgtagacggtcgtataccggccgaggcgctccaggatttcttcctgcagcgattcaggcacgacgttcatgttgaggtaccatgccgtcgacgacagccgcgtctggaacgacccgtattcctgcatcaattcgtagaacgcgtcggcatcctgatcgcggcagacgatcaccaagtttcctgccattccctttcctcccgctcgtcgatcgatccccagggcctgcggacaccgggaacgcgcatgcgttgccatcggtacggccgcaaccgaccccagggccagccccgatcatacccgcttagtcgtatcgggctgatgacgcccgacatggtttgcgcgtgcgtgcggcgggcgggttcccggccgggccggatcacggcataattcgggcctgcgtgccggccgaaggagtgcggccgggctgcttgtaccgcgcacccgtcattcgcccgcgcgccaggcacgatccgtgcaccgcctgcgccgttcccggacggttgtacctgaaatacaggttggtgtagtgtcgtgccgtcgcgggccggcacgtccggcgcgcggcagcgcgtgcacgcacggcgcaccgcgctcgcgcgcgatcgtcagtcaatcgaattaccgcacccgtgcgctttgccatgaatcaacatcgactgccggcttcgttcggccttaccgggagggcgcctgatgaacgtcggattcttcaatccgaaccggaccgccaacgcgtccgcatggcgtgttctgccgaaccggtgggatttcatcgcgtttccgctgatcatctgcctgatcgcgatggcggtcgtcggtttccacgaaacgatggcgccgatcggcaccctgcagacgcagaagatctcgctcgacccgtcgaacctgcccgaatacgcgctgcgcaccacgctgcggatgctcgccgcgatggtcgcgtcgctcgcgttcacgctcgtctacggcacgctcgcggccaagagccgtcgtgccggcatggtgctgatcccgatcctcgacatcctgcagtcggtgccggtgctcggcttcatctcgttcaccgtcacgttcttccttgcgctgttcccgagccgcgtgctcggcgccgagctcgcggcgatcttcgcgatcttcacgagccaggcgtggaacatgacgttcagcttctaccagtcgctgcgcacggtgccgcgcgacctcgacgaagtgtcgcgcggcttccacctgacgtcctggcagcgcttctggaagctcgaggtgccgttctcgatgcccggcctgatctggaacatgatgatgtcgatgtcgggcggctggttcttcgtcgtcgcgtcggaggcgatcaccgtcggcaaccagaccatcacgctgccgggcatcggcgcgtatctcgcgcaggcgatctccgacaagaacttcggcgcgatcggctgggtgatcctcacgatgaccgtcgtgatcctcgcgtacgaccagttcctgttccgcccgctgatcgcgtgggccgacaagttccggatggagaacaccgcgtcgggcgacgcgccgcaatcctggctgctcgacctcgtccgccgcacgcgcctgattcatcagctgctcgtgccggccggctggttcttcgcgaaggccgcgcggattccgctgcgcctgccgctgtcgggcgcgatgcgcttcacgctgccgaaagtcgagaagaaggcgtcgcgcacggtcgacatcgcatgggccgcgctcgtgctgctcggcacggcctatatcgtgtggcgcgtcatcagcttcgtgtcgaccggcgtgacgatggccgaggtcggccatgtggtcatgctcgggctcatcacgctgctgcgcgtggtcgtgctgatcgcgatcgcatcggtcatctgggtgccgatcggcgtgtggatcgggctgcgcccgcggctcgccgagaagctgcagccgctcgcgcagttcctcgccgcgttcccggcgaacctgctgttcccggtgttcgtgatcgtgatcgcgcgcttccacttgaacgccgatatctggctgtcgccgctgatcgtgctcggcacgcagtggtatatcctgttcaacgtgatcgccggtgcgacgtcctacccgaacgactatcgcgaagcggcgacgaacttccgcatccgcggctggcagtggtggcggcaggcgatcctgcccggcatcttcccgtactacgtgaccggcgcgatcaccgcatcgggcggcgcgtggaacgcgagcatcgtgtcggaagccgtgcagtggggcaataccaggatcgaggcgcacggcctcggtgcctatatcgcgcagaccaccgccgccggcgactttccgaagatcatcctgggcatcgccgtgatgtccctgttcgttaccctgttcaaccgcctgctgtggcgtccgctgtatgccttcgccgaagcgaagctgcggctcgactgagaccgattgagagcgaaacgcgatgcacaatccgaatgctgtaaacgcccccgtccagacgaaccagccgccgcgcctcggtgaggaaatcctgcgcgtcgaccacgtctgtcgcggcttcaacaagacgcagggcgaactgctcgtgctcgacgatgcgaacctgtcgctgcgcgaaggcgagatcgtcggcctgctcggccgttccggctcgggcaagtcgacgctgctgcgcatcatcgccgggctgatcgagccgaccggcggcgaggtgacctacctcggcaagccgctgcgcggcccggccgaaggcgtcgcgatggtgttccagaccttcgcgctgttcccgtggctcaccgtgctgcagaacgtggaagccgggctggaagcgctcggcgtcggcgcgcgcgagcggcgcgagcgtgcgctcgccgcgatcgacctgatcggtctcgacggtttcgagaacgcgtacccacgcgagctgtcgggcggcatgcgccagcgcgtgggctttgcgcgcgcgctcgtcgtcgacccgacgatcctgctgatggacgaaccgttctccgcgctcgacgtgctgaccgccgagacgctgcgtaccgacctgctcgacctgtggacgcaaggccgcatgccgatcaagtcggtgctgatcgtcacgcacaacatcgaggaagcggtgttcatgtgcgaccggatcctcgtgctgtcgtcgaatccgggtcgcgtgatcgccgagatcaaggtgccgttcaagcatccgcgcaaccggctcgacccggcgttccgcaagctggtcgacgacatctacgcgaagatgacggcccgccagaccggcgaggcgacgaagaagggctggagctcggcagctggctgccgcaggtgtcgaccaacctgatggccggcctgatcgagacgctcgcgatggcgccgtaccacggccgcgcggacatgccggaaatcgcgcgcacgctgcatctcgaggtcgacgacctgttcccgatcgccgaagtgctgcaatacctcggcttcgcggacgtgcgggaaggggacgtgttcctgacgccgccggggcgcgtgttcgcggaattcggcacgcaggagcgcaagctgatgttcgcggatcacctgttgaagcacgtgccgctggccgcgcggatcaagaaggtgctgaacgagcgcccgggccatcgcgcgccgcgcgtgcgcttcgagcaggagctggaggatttcctgtcggacggtgccgccgaggagacgctcgacgcggtgatcgactgggggcgttacggcgagatcttctcgtacaacgaccagacggagattttcagtctcgaggacgtcgagacctgaagccggccaggtctcgacagcatccggcggacacggcgcgaattccatgacctatgactgaaaaagggaatctgtacgccgtcgcggtggaaacgtttgacctggtgctcgtatccgttatcgactccccgggtccacagatctttcgggcgaaggtcgagcgcatctattccagcggcaagagcatcacgccggatcgcctcggggcggtgatcgagttctgcggcggtccgccgacctggggcaatgtgccgcttcaggccgggagtgcgccctcatgttcgtgagagtgcaggccggcatgctccatgaatatccatggcgcggccacatggttctggaggaaattgacggtgaatcgtacgcccgattacagattcccgagttgtggttgagggacgatctgccggaatccgtgaaggccgcgacgcgtccgcatccgaccaggcggaatgcgtcgatcgtcaggctcggtgtgctggagcattacctgatggacttgatcggaaagtcggcgcgctgagccgagcgcgcgattcatgcgcaatgattcgcgccggcgcggttggagccgtcgcagggcagtcgatgtccgggccagccgccggcacgcggtgcctccgctactgcaaattccccaccgatcgaccgccggttccgccgacgcccacttccagtgcgtgccttgctggcacgcattcgcgaaaaccagtcggccttgtcgccgtccttcaccgagaacgcgaattccttgcacagcgcgagcgccgacgaatacgcgcgcgtgacccgcacttcgccttcgccgttttcgagcggcagcgtgttcttcaccttccacggcttcacttctccgacggcgagactgccggccgtcttcgcgatcgcgtcctgctggttctgatggagctgcttcatcgtgcggttcacggcttcgtcggtcgcggcctgcacggcgatcccgacgccgacgccgaccgccgggttcgcggtgacgaggcccgtcgccgcgccggcaagcgcgccgctcgccgcgccgaccgacccgcagcccgacagcgtggccgccgccgcgcacagcgcgccgatggccgcgatacggatcgcgacgctcattgcagcgagccccagcgttcggttgccggctccgccgacgcccatttccacacggggccgtcgcggcagatcgtggcgacgtagaacgccgattgcgcggccttgtcggctttcgcgggcgtgtcgactgcgaacacgatttccttgcagtcgagcgggccgatgctgatcatccggctgaccgtcacgcggccctgttcgtcgtcctcgatcgggaacgagtggtgcgtcgaccacggcgcgacgccgcccacgtcgagcgggccggccgccttcgcgatctgttcctgtgtgtaacggtgtgcgacgcgctgcgagtactggacgcccgcacgcgcaccggcgacggcgccgaggccgatgcccgtcgcgacggcggcgttgttggtgaccttggaggcgatcgcggcacccgcgataccggcgccggctgtcgcaccctcgctgtacagcgagttgcagccggacagcagtgcggccgcggcgatcgcggccagcacgacgcgcgccgggatggcccggcgcggcgattcgaaacgaatgttcatccctgagtgcaagtcctgtctgggtgagcggcaacgcgtgcgcgccctcatgccgcgtcattgtttcgcaattgtcataggaaaaatgcaaagctttgacaaatcgccggacggcatcccgcgcgtacgcgcggcgttattgtcggacaggtggatcgtgagggtcgaaacgttacaaattgaaggtaattgttactttggcgtgcaaggaagcgacctagacttttcagttatggaatgtttctacgacggcctcgggccgcgccgcacatgagacacccggccatgcgacgttcgaaacggttttcgtcccggccgcccgacacaggggcggttcgcccgcatccgcagaccgacgcgccatcggcaccgcctgccggcgcgcccggcgagacgccgtccgacggcgatcacaaccagggtggtgcccgcccggaagggctcgactatcagcgggatctcggtcaggagcaggacgcctgatgtcgttgtcgtcgtattccgccgctgcctttcacacctgcatttctcacgtctgaatcgccgcacggccgccttcgggcagccgtgccagccttggcgcgcgccgcgcgccagcccatcgaatcgaggagggaaagccgcatgagcagattgatcgtggtatcgaaccgtgtcgccgccggcgaggacacgcgcccgagcgccggtggcctggcggtcggcgtgatggacgcgctgaaggaaacgggcggtgtctggttcggctggaacggcgagatcgtcggcgcacccgacaccgagccggcgatccagcgcgacggcaacgtgacctatgcgacggtcgggctgacccggcgcgactacgaccagtattaccgcggcttctcgaacgcgacgctgtggccggtgttccattaccgcggcgatctcgcgcgcttcgaccgccaggagtacgcgggctatctgcgcgtgaacgcgatgctggcgaagcagcttgccgcgttgctgcgtcccgacgacctgatctgggtgcacgactatcacctgctgccgttcgcgcattacctgcgcgaactcggcgtgaagaatccgatcggtttcttcctgcacatcccgtttccgtcgcccgacatgctgcgtctcgtgccgccgcacgaggagctcgtgaagttcatgtgcgcgtacgacgtcgcgggcttccagaccgaggccgacaagcaggcgttcaccgactacatcgagcggcgcgggatcggcgcggcgagcgacgacgggatgctgcacgcgcacgggcgtgtcgtgaaggtcgccgcctatccgatcggcgtttatcccgacgcgatcgcgcaggcggccgtccagtacggcgcgcgcaagccggtgaagatgctgcgcgaggcgctcgacggccgcaagctggtgatgagcgtcgaccgcctcgattattcgaaggggctcgtcgagcgcttccaggcgttcgagcggatgctcgcgaacgcgccgggctggcagggacgcgtgtcgctcctgcagatcgcgccgccgacgcgttccgacgtgcagacctatcaggacattcgcgaaacgctggaaggcgaggccggccgcatcaacggccgcttctcgcagctcgactggacgccgatccagtacctgaaccgcaagtacgagcgcaacctgctgatggcgttcttccggatgtcgcaggtcggctatgtgacgccgttgcgcgacgggatgaacctcgtcgcgaaggagtacgtggcatcgcaggatccggccgatccgggcgtgctcgtgctgtcggagttcgcgggcgccgcggccgagctgaccggcgcgctcctcgtcaatccgtacgacctgtcgcagatggccgaggcgctcgagcgcgcgctgtcgatgccgctcgcggagcggcaggcgcgccacgaggagaacctcgcgcggctgcgcgggaacgacctgtcggtctggcgcgatacgtttgtcgccgacttgcgcagtgtcgcggccgccgcgtcggtcacgcggcgcgcgggccggcgggtcgtgcatgcgtgaggccgtacaggggcccggcgccgccgacggcacgagcgacgacgccacccgccgcttcttcgtcgtgaccggtggcccgggttcgggcaagagcacgctgctcgatgcgctcgagcgcgctggttgcgcgcgctcgcaggaagccgggcggggcgtgatccgcgaccagatggcgatcgacggtcacgcgttgccgtggcgcgacccggccgcgtttgccgagttgatgctgagctgggagatgcgctcgtacgatctcgcgcggcatgcgcgcgggcccgtgttcttcgatcgcggcgtgccggacgtgatcggctatctgcggctgacggggctggccgtgcccgcgcatgcggaggccgcggccaaccgtttccgctatcacccgcgcgtgttcatcgcgccgccgtggccggacatctatgcgcaggacaccgagcgccggcaggatttcgcggaagccgtgcgtacctacgacgcgatggtcgagtgctacacgtcgtacggctatcggctgatcgaactgccgcgcgagagcgtgcaggcgcgcgtgcgtttcgtgatggacgcgctcgacgccgaatgacgcgcggggcggcgcgcgacggtgtcaggttgccgcgtccggtcgcggcgacgcgatacgcagcatgctgacgagcgcggccaccgccgcgaatgccgcggcgacatagagcgcaatcgtcggcccgcgatcggggacgagcccgaaaatcaatgcgacgagcgcagcgccgagcgtctgcccggtcagccgcgcggtgctcagcatgccacccgcgccaccgctgcgttcgcgcggcgccgacgacagcatcgcgcggttgttcggcgactggaacaacccgaagcccgcaccgcacagcgccatccgccacacgatgtcgacggtgcccgggtgcgcgccgatcgtcgcgagcgacagcagcccggccgcgaacagggcgagcccgatcccgccgaggatgcccgcggaataacgatccgacagcacgcccgcgagcggcgcggcgaacacgatcacgagcggccagggcgtcatgtagaggcccgtctcgacctgcgagaaaccgagcgagtgctgcagccagaacggcagcgcgacgaacgcgagcatctgcgacgtgaacgacgccatcgacgtatagatcgacagcgcgaacatcgggatgcgcatcaggtcgacgggcagcagcggcgccggctgcgacagctggcgcttcacgaagaagtagccgacgacgaacgcgacggccagttcggccgcgacgtacgcatggccttcgccgtggccgagcccgtcgaccgccgtgatcagcagaccgaacacgcacgcgttcatcagcgcgctcgggaaatcgtacggcgcatcgtgcaacgggttggacggcagcgcgcgcaggctgccgatcaccgcggcgatgccgatcggcacgttgaccgcgaagagccacggccacgatgcgaacgacaggatcgcggacgcgaccgtcggcccgatcgccgacgacagcgccacgaccatcgcgttgatcgacagcccgcgcccgagcatcgacgacgggtagatcatccgcacgagcgccgcgttgacgctcatgatgccggccgcgccgaaaccctggatcacgcgcatcacggccagcatcggcagcgagccggcgagcgcgcagccgagcgacgccgcggtgaacagcgcgagccccgcgacgtagatgcggcgatagccgatgcgctcgccgagcgaggcgagcggcagcagcgtgatcgtgaccgcgagctggtatgcgttgacgatccagatcgatgcgacgtcggacgcgtgcaggtcgcgcgcgatcgtcggcagcgcgacgtttgcgatggcgccgtcgagcacggcgagcgtgatgcccagtgcgacgcagacgatcgcccagtagcgttgcggaagcggcaggccggtatcggcgttcatggcgggagcagatgcgtggttgtccgcgcgcccggctgccggttgcgtgcgcaaccatgcggaagggtggaggcggcgatgagcggcccggccggcgcaactgcaccggggcgtggccggccgagtgtatcaccgggccgcattgcgcgacgtcggcactcagccttcgaagtcgaggccgccgagccgcacgagcgggtcggcctgcgtgcgcgacaggagatcgatgtcgcgcgcgccctgccatgcgcccagctttttcgggagggcagccaggtagtgctcgaagcgccgcgggccgtccggctccatcagccgctcgatttcgtcggtgtcccaggtcagttcgagattcagcggatgctcgaagccgctgacatgctcgtgcggcgcgctgcggatctgcacgcgcgtcgggtgcccgtggccgccatacgggacgacgtcggtcagcacgtgatcggcgaagaaggcggcgatcgcctgtgcgatgcgcggggcgaattctgtatcgaaacggcgggcggtttcgggctgcatgaaggcgtctcctgtatgccgaaaatcctagcatggcggcgccgcgtttcggtgtgcgtgatagcggtaatcgcgcgttaccacttgctgcatctattacggccgcctgccgccacaatgcatcgcatccagtaccacttcgcgtgggagcccatcatgaaaaaattgccgcagtgtgtgtcctcgccggttcgcttgccgtggcgggtccggcgtccgcgcatggccgcgacggcggcgccgtcattggcgcattgatcggcggcgcggtgctgggcgtgatcgtgacgtccgcgatgaatccgcccgtcgcgtatcaggcgcccgtgtaccaggcaccggcctatcagccgccgacgtactaccaggcacccgcgtaccagcagcctgcctatccgacctaccagcaggcgcagtatcaggacgacggcccgaactattgctacgaccgctaccagcgcgcgtacgtgtgcggcgcgccggtgcggggcggctacgcgcagccggccgggtggtaagcgggcggatgcgtgacgcgtgtcgtgtgaccggccagtgccggacggcctgcgccgccgacgttcgcttcgccgcaccggacgacaaaggccctcgcttcgtgcgagggcctttgtctttgcgcgggagtccggtcgtctgcgtaacgcacgaccggcaagaccggcacgaccgctcatcggcgggccgtgcgcggatacaaacggttgcaattgtgcgtcagtggcgatggccgccgcctccgccgccttcgttccagtcgccgcggcgtccgccgccgtgccccagccgttgccgcggttgccgcgatcgccgtcccagcgatggtagtcgcgccggccgcgatcccagtcgcgtccgccgccaccgccccagatgttgaccgtgccgtacacggggacggcgcgtaggcgtagcccggatcggaatagtagggctggccgtagccgtatccggcgtccggggcgacgacgcagccggccagcaaggtcgcgacgccggcggcagcaatgagcttcagcatgatgttctccgttggttcccgtataagtaccgcgcaaggggattgccagctgtttgcaattgtgtcgtcaaattacagcgccgtaaggtcatgcgacgaaagtgttagcatccggagctcatttgttttccaggagtacctcgatgaaattcgcgatccgggccgcgctggccgccttgtgcgtgacgactgccgccgcctgcgtggccgcgcctgcatcggcgcccgccgtgccggccgagtcgatcaagatgtttccgcaggcagcggccggccagcagcgcgtcgtgatcgcgctgcccgcactcgagaacgaaggcgatgcgcgcgtcgaactgatgatcggcaagacgttgcagaccgactgcaatcagcagtggttcggcggcgagctgaccgccgaggacgtgaagggctggggctatacgtactaccagctcaccgacgtgaagggcccggcgtcgacgctgatggcgtgcccgggccaggcgccgcagcagcggttcgtgcaggtgcgcggcgatggccaactgctgcgctacaacagccgcctgccgctcgtcgtctatgtgccggacggtttcgaggtgcgttatcgcgtgtggcatgcgtcgaaggacgtgcagcacgctgaaaggcagtaacccgcgggggcggccgtgtgcggcggcgtcctgccgctacgcgccgcccataccgacgagcgctggccacgcggccagcgcagccgtggcgacggcctcgagatcgcgacggctcgcaccatcgcgggcctggatcgacatcccctgctggacggttacgtagtaccgcgcgatcgcgtcgaggttcgcgtgcgccgagatctcgccggtcgcgacaccttgcctgaggcgctcgcgcagactctcgaccgtgccctcgcgcatcgcgatcagcgtttgccgaaccgtatcggagcgctcggccggatgcagcgccgacagcacgaccaggcagccagccggcttcgaccgccgcgtgaacacgcgtgcggtatccatcaggtagttccgcacggcgtcgtgtgcgctgccggcctcctcgacgcccccagatttcttttcctccgttgcgcggtagtgctcgagcgcttgccggaacaatgcttccttgctgccgaacgccgcatacaggctcggcgatgcgatgcccatcgcggccgtcaggtcggtcatcgacgcgccctcgtagccgaggcgccagaacacctccatcgcgcgttccagcgccgcttccttgtcgaagctcctcggtcggccccgttcagccattgcgtccgttccttcgtcgatatctgtgtcgatcgataaaataaatcaattgactgtgccgcgcaacttgccacattctgtgccggtcgttacataaatgaggaaaggaaccgacatgaatcgacttcaggccaagcgtgcactcatcacgggcggcagccgcggcatcggtgcggcgatcgcgaaacggctggcggccgacggcgcggacgtcgcgattacctacgagaaatcggccgagcgggcgcaggccgtcgttgccggcatcgaggcgctgggccggcgcgccgtcgcgatccaggccgacagcgccgatccggtggccgtgcgcgacgcagtggatcgtgccgcggaggcgttcggcggtctcgacatcctcgtcaacaacgcggggattttccgggccggcgggctggacgatctcacgctcgacgatatcgacgcgacgctgaacgtgaacgtgcgcgcggtgatcgtcgcgtcgcaggcggcggcgcggcatctcggcgagggcgggcgcatcgtgtcgaccggcagttgcctcgccacgcgcgtgcccgatgcggggatgagcctctatgcggcgagcaaggccgcgctgatcggctggactcaggggctcgcgcgcgatctgggcccgcgcggcatcacggtcaatatcgtgcatccggggtcgacggataccgacatgaacccggccgacggcgaacacgccggcgcacagcgttcgcggatggcgatcccgcagtacggcaaggccgacgacgtcgcggcgctcgtcgcgttcgtcgtcgggccggaagggcggtcgatcaacgggaccgggttgacgatcgacggcggcgcgaacgcgtgatcgcgtgatggcgggacgcccggtgtgagttgaccgggcggcgtggcgttcgttatcggcagccgagccgttgatgctcggcttcgagatcggcgcgcttgtcgtaagcgcgcagttcgttgcgcagcttgccgtccgggcccatcctgcgcacgaccttctggccgcggtcggggtgtgcgtcacggcgtcgatgccggcagccagttcacggcagcgtgcgtcggaggaggtttttccgggcgcggtgccgctgcgttcgcgacgttggcgatgccggggctgacatagcgccgctttgcgggcgcggtgatggtgtcggcggcgttcgccgtgccggtaatcgcggaaagcgcggcgagtgccgcgatcgttcgaatcattacggaagtccggatgctgaagaaggttcggaattctacggaatgtctggtgcggagccgtggcgatcgggcgggatgcgatcgtgtgtcgcaggcggtgtcggcggctgaatgttccgcagtttgtcggcgatgccggccaggcggtgcacacgcagcagtgcatgtggaaagcaaaaagcccgcttgctttcgcaaagcgggcttcggtattggttgcggggtaggatttgaacctacgaccttcgggttatgagcccgacgagctgccagactgctccaccccgcggcgcgaagtgtacttgggtgagggcgggagtcaaccgattcgtaacttgtgctgcgcgccgcgactgttatggagcagttgggccctcggtgaccttcggccctccttgaagctcggccttgtatgccatcggactcaagctgagctgcacagtcagatcgccttcaaggacgaacgcttgtgctgactgcgaattgcgatcaaattgatacagtcgatacaaggcataggcttcaggattcttgacgctgaacgcgatctcattgggagaaatataaaaggcggtatgagcgtcgccttgggtcgtcttcacttcaatatatcgatcgcgtccgtcggggcggaaagatctaacgtcatagcctgcaccgtcgccttccaccacagagacgtgggttactcgatttgctagatcgttgcggccagcagcgataagcgctgctttctcatgctcgatcacaagcagttcgccttccaagcccaacgcgcgatttcgagcgtcttgtgcagaatagtcgggcgactttctacgacgaaagtcttcggacgctaccccttctcgggaacgtttcggtaacgctggattgacaaacgtgatgcctgctgaatgcggagatgccggctcagcgggcatagaatgatcggccgttgggaccaagccgatccgatctagcacttccttaggtgctggccattcgtgcaattgccattggaaatgcacaggcttttctcgcagagcgtcatgtgtaatgtagctgatcgttcccaggtagcagtagggcgcgcggcgtttcgtgcgcagaaacaagtgaatattgttgactcgctcgtcgtgacgaatgagttcgcggatcacatcgtcagcaactcgctgattgggttgggattgccagcttagaacaccgctttccgtgatcgactcatcaaaaacgtgatctccttgctcttgcccaaacgtaacgaagaacacccagtctccacgtcgagcagggactcgaaccatgccctgaagccccaggttcccgcttgaggtgtgaatttcgtatcggggaaaaatggcgtgtacgtcttcgcgactatagtcgttccaaagcgtcaggttcggcatatatggacaagctgtgcattaaagggtcatggcaccagttatctcataatacagatctgccttagctgtcacacggcttaatttcatgcacgacttgttcgtgagggcctcatgtggcgacgttgccgatggcggctctgacgaggcgacttcagattggtgcgcgtgccaccagcgtctgctgtcgcaattttctgatatcaacaaagagatcaacagagtctccagctgtcactgagcaactttgactaacgctgcgagctagaaggccaccggatgggcccaggcaggtaatacgtgcgaatcttgggaatggcttgaggcttggctggtccccgacagaattcatacctctaggctgcaaaatgcttatacgtgtagccgttccatagataccaacaaaaataccaacaggtgtcgaaggataggcgcgcttggtgagggtggtcgctttaagtagccttggccgcgccgctggaagcaaaaattttggagatttggagacaagtacttgtttcggtctgtcggccttgtctggcaaggatgccggtatctccaaacgtatctccaaatccatcatttacttggagacaaagttggagataaggggcatggcgctagctcagccgcagtgcggatgacggtatggcctggaacgtcgcgcgcaaagcgtcgcccccgcgcccctcccgaccgtggtgcggctataagagtttgtccgtggagaatcgagatttcgttgtcgaccgtcgggtactacgtaacctcaactcggggatgtctgttcccgagtgcgcgccctccttcagcgagtactaggcgttccgggtatctgacgtgccgaaaaatggcgacagatgatgctttgccttagaatcagcaaacccgcatttgaccgcctaggtggacgtagacatgaaatcgcgattcttgaagctgctggatgaagcgcaatcattgacgcccggtccggagcgtcgcgctgcccatacggcgttgtttcgaatcctcgtgcagcacgtctgcttggtattggcggagctgatattggaaatgcgtcgtcggacaccgacaaggcaggacgaatcccctttgccagttgagagcctgaggatgccggctgatgggacacttgtgtccgccatattggacatgcttgtaatcgcagagaatgagcatcttccgggatatagcaaagcgatctggcgagactctgacgagtcacgaccctgctggagccttttggcaacaggtcagagaaggaacgctgagcgattgatgcaggctctcgtttctgtacgaaacgacggcgttgagggcatggaattgcgggtgagggggactacgaggctgagtgtgatgcacttcgatttctaattgaaaaatttcagccgttgctgcctgaaatggatgccgacggggaaaatttctcgctttctctcccaatggtgagagatacgcggtgaagctcttgaggccgtatcaagggaatctcatttgttatcgaaatattaagcgatctaccgcggcgcgatgtgtaattaaggctcaggttgagaagggctggtttcggcgagatgaaatatcatatgaaacaactgatgttttcgatacggcgataattggcgaaatcaatcggtatgaaataattagaacaaactcggacgaatggtctccgctggctttgctgccaaatcgattgacggacgagttcgctggccggcaaagagagatggacgagttgcatgattggttcgatgatgttgaatcgcgagcctgcatgctctacggcgacggcgggattggtaaaaccactctggcagttgagttcattcatcgagttattgaaggtcaaatagagacaaaatatcggcctgaatttataactttttataccgcaaagaaaactcgatggggattgaatggactggaaattattcgattgacggatgtcggtgctgccgacgtcgctacgttcatcccaagagcactcgaaggaggtagccttgatcggtcctggtacagcaagtcgcctgatgtattaattcaaatgttgtcggcttatctcgctacaacttggggtgttaatcgtgactcgcatctgctgatactcgataacaccgaaaccatggcggcgaacgcggatgaaattcgaattttgtcgaagcaaattcgggagctttcgcgacgggtcgggcgagtcttgctaacttcaaggcgacgagaggcaattgaggcgaggcatatcgaaattaagcctcttgaagaagatgaatctcttcagtttttacgcgcgcgtggaacaaatttagggcgtaggtcgatcgttgatgcggggatagcacgcttaagcgatacgctcgtttgcttggtaataagcctttggtgttggaggtttttgttcaggctctcggtgagcacggaattggattgcaaaaagcattcgatcgagtgatgcggatgcaaacgcaagatctgggtgagtttctatattctgatgcttggaatcgtatgtcgctcacaatgcagcatttgttgctgcttatgacgaaggtaaccgacatacatgatgatacattgctgaagctatgttgcattcaggttgggatttcagtgcttgaggcatacgaggcgctggaggaaagtcgtggcattgctcaaattacaacatttaacggaaatactcagatactcttgacgccagagtttctgaagttttgcgctgatcggactattacaatttcgggaatgtcgcgccgagtgatgcgagcgtcgagaggattcgaaacaggtataacgaattccttcgcagtaaatcggctatggttacggatcgagttgctcgggcatatagacatccttatgcgcgtgctgcatatatggcatttcgcgacgggcgtgacgacgattgtgaaatgttctacgatctcgcagtaaatgcagatgttgagaacggttggctgtacgatcgatttgcattcttcttgtctacaaggcggcaaagcaggcaagatgaagcgctagattgggctaaaaggctacggcattaattccggacgatccggatgcgtggttcacgcgcggagcgattgaatcgaagatgggggttgtttctgatgcgcaggtgtcgttggatcgtgctgcatccctaggaaagcacaagcatctttgtctactgcagcaggcatatgcatatgccaacgacgagccgccgaatcgcgcgttagcgcaggcgaaactagatgcggctgaagaagctgcgccgaaaaatgacagtttgttgtggaaatttcgaggagaggtcgcgagcttaagaaagagattggctagggacgagtagtctcttgatgttatgtgcaaaatatcggccggtcacggagacgtgaccgagtcaaaaataacgacttttgctttagatctcggcagcgtcgcgcacccgcataattgtttggcgactcgtgcgatactgtctcgcgagaccggcgaccgttgcaccggcattcaattgctgcttaacgtcgttctgctgctgcttggttagggtggaaggtcggccgactacctttccttcggctctcgctctcgcgataccagcttgagtccgctcgatcaatagatcccgttcaaactctgcaacggcattcaacacttgcatcgtcattcggccggcggcactggtgaggtcgacgccgccgagcgcaaggcagtgaattcgaatgccgcgatccgacagggtctcaactgtcgcacgcacatccatcgcgtttcttccgagtcggtcgagcttcgtcacgatcaacacgtcgccttcttccatcctgcggagcaagtccgcgaatcccggccgttgttccgcgctaacgctgccggagatgctctccgtcacgactcggcgactatcaacagcgaagcctgcaacctcaatttcgcgaagttggttagctactgtttgatcgctagtgctgacgcgagcatatgcaaaggttcgggacatgttgcagtctagaatgtacgaaatcgatgtccgaattatatccaatgtccgtaatgtgtaaagccttattttcggacacggttgtacgcccatgtccgtaagggaacggtttcggacgccctatgcggtgagtgaggtcgaaggtctgttcgttaattgagacgactgtggcaactcgtggactgggcgtcaacgagccgcccagaacaacagactgccgtcgctttatcgcgcgtaatgccctgagcgatggttagtcagcgccgaagatagcttcgatgaacggattggaaggcaggccaatgactagcggtgtcacgcttacgcgtgcgttgtcgattgcgttgacgagcccgaaacctgcaaaggtgcccctgccgccgtccgggcgaaattgtacaaaagcggtggtagtggtcacccatctcggatcaatgacgagcgttactttccggtcgccaactttggtgtatatctgcggatccgtttcgatgtttcccggacagcacgcttgtagccttcgatggtactcggcatgtcaatgttctttgtccgaaacggctggtcaaacgagacaattgtcccgcgagaggcttcaccgatttcgagtgcgcggtggagtgggagagccttcacttcaatttgctcaaggagcgttttgaatccgagcattagaccattcaattcccagcccagctcgtgtagagcgatgatttgtccgtatcgtgataggtcgaggcttcttcctgaaatggcagctaacgcaagtaatctcggaacattcaagtagtagaaattgtgtagctttgtcgtccacggggcttcataacgaagcttgtcggccagccatgaggcatgcagaacctgaacgtccttgagacgatccacggggtattgttcgatgttcgtgtcgatttcggcatgatggttgtagcacaacagcaataggtttgactcgtggttacgttgctgcggagtgaggggcgagtcgcctcgcggaccttccgtttgctccgcgactatatgcgcaacttcgccgcgaaactgggcgggctggtcatcgttgccatccaaaaacacgctcccggcagattgcacagcaaccgccgtcccgcacccaaacggttcgcttgacttttcggtgatcgacatttgaagtttccccagcgcttcgatttatcgtcaaatcagtatagttgtcggttcgaatgtgcgtggaatcgagccgtgggtgccatggcatccgtttagacttttgatgcggtcacagcaagtgcggtggaggcactttgtcggacggtgctctgctagtgcgcaggcggtcatggcgcaaaactgacgtagggacagcaggctatctgagtcggtgcgacgcccgaaccgccgtgacgggaagccgtgagacaatgcggcccgctgagcctagggcggccacccgaaaaccggacaccttcaccggctggctcggcgttcttcgtgaagggcgcatatgaaggatgcgcgatgaatctggatttttgctgctgggtgcctgatccggtgcgacaggcatgcgctggtgtgtgtagcgccgatgctccctatcgggaattgagtgttgaggcggcgaaacggctcgttaccgatcctcggatggagacgttttatcggtccgagtcgcttggctgggcccgtgggccgaatgccgatatcgcatggcggctttggttcgacgcggcactggatgctgcgaattttgatgaagatgcgtcgcgcgaagcgatcaagcggcaacgggccaatgtatcggagcttgtgcgagtgctcgatgaggctcgcgacctacttcacgaaatcgagcaggacgagacgagcgcgcctatttcgataccaatagagttcaccgacgttctgcatctgcttgatgcaaccgctcagcatctgggaattgtggacgactacgataggtccagatatgaggcgaatgcacgtccccgccttgatgagatatttcgttttaacggtagccgtgcctgctttattccgtccgttgctcaacttataaccgggttgtcagcgagcgcatttggtttgcaggcgcagctagatgatcgagcgacaatcccttggcgcgggcaatttgcagctgaccaatttacatcgcagaaaagcaacaagtatcgagcctacgttcgcggcgttgatcgggctatgtgggagcttcgattcgaatacaccgacgaagatcaagtggaatgttggcgactccccgactcgctcctcgcaatccagtgcaaagtagctttgggtgagagcgacttagaaggatttgttgagcgtgtgcggaagcatcggctgaatttcgagagcgacgagttataggccggaagatttttaaatcgaaacggcaaaaacaatccgtgtttcgtttccacgtactcccttaaattgcagactgtcgatgccaatggtggcacagacatgcttagggagcacaaatgcctgtaaagaacgtctccacgctggctactccggccgcgcttccgcttgacggtctttctcgctgggaaagtctgcgttcgtccattcaattgtcccgtgagactgttcgtcagcgtgagcgcgagggaagtttccgcgctcgatccgattgactcagcgctgcacggtctggaataaccgcgaaatccatcgctatctcgctgatccgctgaactatcgcgccgctgatgccgcgaataacgtgacggagggcgcgtgatgacgagcgcaacgaacgcacgagcgatggcgcgtgacaccaaaagacaagccgacgcggagttctacgattgtgaactctcccgcctgcacgaattgtttagcgacgtgctccaatgtaccgagcagggcgtgcggcgcgatgccgcatgcatgattgtcaccgctgcgggcgtcttcgagcgcgacgcggttcggatgccgacgcgcgctaagcatgccgtccgactgctaaaggaggccattttcatgctcgatccgaaggtttcgacgtaatggttcgccaaagtcactttgctgtagcgggggcagtgagttgccgtcgcgttggtccgctctctctggtccgtccctcggccgatttgcacatcgcggcggcgagcagtatgctgtgaacgtcgctgaaacaacagcggctcgggcgtcgcggctcgatatgcaaaggcggacgaccgcctcccggcggtatttttcgtccgtgtgccttcgcacgtctccttcaatggcgggccttggctgaggggacaccttcgggtgtgccggtttcctttgcgccggtccgcgaaccccaaagccttgcgcctgccaccatcgcttcgcggcggtgatggcgggtttcgaaaccgctgcaaaggaggccgcatccaatgcgccagtccacgcacgcccgtaccgggcagcaatcccacctcattcaatcgattgtccgcgcagcactgcgcgacgcggcaaccgccagcacgtatcaggacgcgctcgacgcaaccggcgcggcactggccgcgatcgccgcgctcgttcgtgcggaggtacgtcatggctgaactgcgctgcaagattggcgatctggcgatcgtcacgcaatgcgatgcacgctcacgcatcggcatgctggtcgaggtggcatcggctcgtccgacgcccgatcacgattggcgcgtgcggatcttgggcggccctgtctcggggcgtagcgtttgcggtcgccggtctggcgagttcatgcacgcagccgtccacgactggaacctcacgccgattcgcggcgaagcggagctggattgcacggtcgaagttgggcaactcctcgcgtcgattctggaggtgcgccatgtctaaattccgcctgccgaacgaagtcacgatgatcgccatgtgcgcggcccatcagttcgcccagctcgaagctctgttcgatgctgtccgttcgcatcttgcggagggcacctacgagcgcgcgctcgtcgacatggggcaaagcgtcgcgagccggtactccgccgaaatgcgccgcaccgcgcagccggaggtgtgccatgactgaccagcgcatccgaaccgcggttatcaatggcttcgacaatgcgccgccgctcgataccggcgcaccgatcgagttgcaattcgccgtcgacctgggcgcgatctgcgccgacgcatggctcgacctgaaaggcaacgtgcggctgcacgactacgcggcccatcaagccgctgcgttcgcgcgcggtatggaagcctccatgcaggacgcgggcgacgtcgacgcgcaccgcgtgacgatcagccgccaagcattcgcggccggcctgatggggcgcgtgcaacagcacctgttcgcggcgctcggcctcgtcacgcgcgaaccgcgcacgacgcactgaggggcggtcatggcaaagacgaacaagaatgccgtgcaaccgctcgcgtcgcatttcgtggccgaggtgaaccgccccgatcgcaaccgaatcggcacgcggatcagcgatgcaatggagctgctggacagcctgcattgggcggctgacaaggccatgtccgatgacgactactggcttgtcctgagcctgttccgcgcgtccctgccgtcgatcggcgcggcgctggaggcggccaacgacgcccttggcgagtcgcggctcggccgctacgtctacagcaacgacgtcacggccggcggggcggttctctcggtgcctcgcgcggtcggctgacgctgcgccgctaggcatcatcgaatcattcaattcttcgcgcgtcgggtagctgcttgcccgatatggactactaatcgggagtctgccgacgcgcgtccagtgggaacctatgagtaacgcacccatgtccgaattcgagcgggcgagagtcgcgctcggctatgttccgcccgacgaccgcgacacgtggagtcaggtggggatggcgctcaaggccgagtttggcgaggagggcttcaccctctggaacgaatggagccaaggcgcgcagaactacaacggcaaggacgcgcgcgatgtgtggaagtcgttcaagggcggcaagatcaccatcaacacgctgtttcacctcgccaagctcggcggcttcgatccgcgcgcgcatcgggcgaagccggtcgatccagcggagcgcgagcggcagaaagccgagcgcgcggcacgcgaagcggccgagctggccgaactgaccgagaaacaggaagccgcgtcggcgctcgctgaatcgatctggtcggcggccgagcccgcgccggccgatcacccgtacctcgttcgcaagcgcatcccggtcgacgcgctgcgcgtctatcgcggcggcttgtgcatcggcacggccgcatgcgacggcgcactcgtcatcccggcccgtgacgcggacggcaagctgtggacgctggagttcgtcctgacggacggccagaaacgctatctgccgaacggccgcaaggcgggctgcttctcgctgatcggcggtccgctatcttccgcgccgtccgcgctgctgattggcgagggttacgccacgtgcgcgacgctcgcggccgcgaccggctatccggccgctgtcgcgttcgacgcgggcaatctgcacgcggtcgcgacggcgctgcgcggcctgtatccggacacccgcatcgtcgtatgcgccgatgacgaccacacgacgaagggcaatccgggcgtgacgaaggcccgcgcggcggccgaggccgtcgccggcatcgtcgcggtgcctgacttcggcccgaaccgcccggcggccggcaccgacttcaacgacctggctgcgcacgtcggcccggatgcggtggccgccgccgtgcgctctgcgctcgcgccgaccggctcggcggatgccggcaagggcaaggcagcactgcccgccgcgaaacccgccaagcgccccaaaacggcccgcgcgcaggacggcaagtctcggttcgttgtcgacgacaagggcgtgtggtttcacggcttcaacaatcagggcgatccgctgccgccgcattgggtcagcacgcggatcgacgtgattgcggagacgcgcaacgagatgaacagcgagtggggctacctgctcgaattcactgatcgcgacggcatcctgaaacgatgggcggttccggccggcctctttgccggcgacggtacggagctgcgccggatgctgctcgatatgggtgtgaagctcggcgtcacgcagatcgcccgcacgcagatcgcgaactatgtgcagatggcgcagccggacgagcgcgtgcgctgcgtgccgcgcgtcggctggcatcacggcgcgttcgtgctgcccgatcgcgtcatcggcaccggcaaagaggcgctgatctatcaggccgacacgccgatccagagccagttcaaggagcgcggcacgctggatgactggcaacgcgaggtcgcggcctactgcgtcggcaatagccggctgctgttctgcgtcgctaccgccttcgctggtccgctgctgcacttctccgggctccagtcgggcggctttcacctgctcggcacaacgtccaagggtaagtcgacgggcggcgtcatcgccgcatccgtgttcggctcgccggactatgtgcggagctggaaggcgaccgacaacgcgctcgaagccgtcgccacgcagcatagcgacgcgctgctgatcctcgacgaaatcggacaggtcgagccgcgcttggtcggcgatgtgatctacatgctcgcgaacgagtcgggcaaggcgcgcgcgtcgcgtagcggttcagccaagccggttctcacgtggcggttgctgttcctgtcgaacggcgaaaagagcgtgtccgcgctgatggccgagggcaacaaacccatgaaaggcggtatcgaggtgcgcttgcctgcgatcccggccgaggtcggcgaaatgggcgtcgtggagaagctgcacggctttccgacgcctgccgcgctgatcgagcatctagagcggcacgccggcatgcactacggcacggcaggccccgcgttcatcgagtgggcgtcgtcgcaggccggcgagctggccgagcatctgcgcatgcgcgtcgacgagctggtcgggcaatgggtgccggacggctcgcattcgcaggtcgcgcgtgtcgccaagcggttctgcctcgttgcggtggccggcgagctggcgacggcgcacgggctgaccggctggccgcagggcgaatcggtcgaggctgcacgtcggtgcttcgaaggctggctcgaactgcgtggcggcaccggcaactcggacgaggcggaagccgtccggcaggtacagcattttctcgccgcacacggcgataaccgtttcgtgtggatgaatcgggcgcaggacgaccatcggccgaacgtgcctcatcgagcgggtttcaagcagcacgtgaagcgcgacgagcggcgcacgcccatcgcctccgatcgcgagtattacgccgagttcggcggcaagatgagcgccgacgatgccgaaagcgtcgagacggagtacctgatcgaagcggccgtattccgcaaggacgtgtgcgccggcttcgatcacaagatcgtcgccaaggcactgatgaagcggggcgtgctgatgccgcgtagcgacggctatccgtaccggcaggaatacatccccggtcacggcaagttcatggtctatcgcgtgctgccgtccatcttcacgcttgagctgtgaaatgcaccgccgccgtccgggagggcggtggcgggcattcctttgcgcggcatttttggcctgcgcgtcaaagttactttgagcgatacgctccagacggaaccggggcggcgattacggcgaatcttgccgtatccgtaacaatccagcccgatttatctccagtatctccagcgttctccaaatcgtttggagacacgcaaagccttacccgtaaggatttgcggccgattccggcgtttatctccaaatctccaactcgttttgcatcgagcggacaggcgtcgaccgaccgtagcgaccgcgaagccagacggggcgcggctctccgggatttgatgggcatcagagacgtgttttcgagggggtgtccgcgatgcgccccgatccggcattgttgcgccggccgcaagtgtcggggtggccggaaagcggggaccctgcgtctagggcaaagacgcgggggctcacacccgcgttttctctctagccgcgacaccccaaggggtcatattcataccgaaatgccggggccggcagtgcggtgccaactctgaaaaatcggtggaaggcgcgcggcaagggggcataaccacgtcgtaggtcgacgcggaacgtcgccctttcattggttagggccggtcggcatggtccgttctggcgtttcgtgtggcttgcgagcctactgctcgccgctgataatcgcgtcagcggatagaggaggaccatgatgaaagatggttggcaagccccgttggccgtattgctcgtggtgatcttgttcgcgtcgttcaacgcaaaaccattggcaagcgccgccgacatcgctgcatgggtgcaaggcataggttcactgcttgcgatcattgcggcaatcggcatctatgccaagcaatataaggataaacaggccgatgacgagaacgaaacgcgggcattcgtagaagcgattcgcgaggaagttcaagcagcatgggacggctatatcactgagatacatccgacgctacaggctctgccagacgggcaggcgtttgaggtggtctaccctgtctcgacggagacattccccatctacgagaacggggcatcaatggtcggaaagatagacgatcccgaattgcgccgcatgattgtcaagacatactcactggcaagggggctgatttcgtctttccagcataacaactcaatgctgactgaacggaagcagctatttcttctatatttccaaccgaatcggaatgaaatccttgaggctcacactatcgctttgcgtaactacgcagctaagctgaaagagcgtgaccgatggattaccgaggccgtaggcgcgcttctggttcgcacgagtcaatggttggcgagccatcatcctgcacgctagtcttgtgaacgtgaagtgcggtcgtcttgcacaccgctcatttcctttgacagcgtcgcttagaacactccatccattgagcggggccgttcattgaaacttcgcatcactttggaatgcgatgcgggcggtctgctaacgcgctgatgcgatgcagatgacttccgcccccgccttgagctgttcgagatgatcagcccacacctgcatcattcgtctgcgttccggcaggtactcagcgtggacgtaggcggccgttacttgattgcgttcggcgtgtgccatctggcgctctacaacgtcccgcccgaagccgagttcacgcaaagccgtagccgccagcccgcggaagccgtgcccggtcatccgcgacttgtagcccatgcgatagagcgcatagagcatcgtgttgttcgaaatgtggcttcggccttgcacgctgtagaacacgaatcgatgctggccgttgagggcgcggagctgggcgagcacgtcgagcgcctgtcgcgatagaggcacgatgtgcgggtcgcgcatcttcatgcgctctggaggcacgcgccattctgcggcggcttcgtcaaactcagaccattccgcacggatcatttccgttgtccgcacgaaggtcagcgccatcaggcggagcgcgagccgggtaactaggtcgccttggtaggcgtcaatgtcgcgcatgagctgcgggatctccgtcgccttgacgcgtgccatgtgctgtacgcccggacctttcttcaagaccgtctgcgcgtcgatgtcggccgccggattcctggagcatcgcccggtcatgattccgtattgaaagaccgcgcgagagcgctggagaatccgcttcgccgtctcgcgcaccccgcgcgcctcaacctcgcgaacgatgctgagcatctgcggcgaatcgatctccgcgatcgggcgagggccgatcttcgggaacacatcgacctcaagcgaattcagcaccttctccgcgtagccgtcgctccagcccggacgctgagagtcgaaccactcgcgggctaccgcttcgaacgagttggccgccgcgatctcggcggcccgtcttgcgtgcttcttcgcctcgcccggatcgatgccggccgcgatctgctcgcgggcctcgtcgcgcttcttccgtgccgtcgcgagcgtgacggccggatagacgccgagggcgagcgtcttctgtttgccaaggaaacggtaggacaagcgccagtatttcgcgccgttcggttggacgagcaagaacatcccgttgccgtccgtgagtttgtacggtgctgcgccggccttcgcgttccgtacctgtatgtcagtgagaggcattgttggtatctgtgttgttggtatctgctgataccaacaaaaataccaacactttctccggctgtcactgagcaaccttgggcaacgatgggcgcgagaaggccgccagacgggcttgagcggggagtttcttgtgaatcttgggagaggtttggggcttggctggtcccccgacaggaatcgaacctgtatctagcgcttaggaggcgcttgttctatccattgaactacggggagcgccatgtccgggtgatcgcgcggaaaaacgcgaaccggacggcagtgtggacagcgcgcagagtatagcaaacgcgcggcgcgtcggcggggcggaatgcacgccgacgcgtgcgatcgcgcaatcagccgcgatcagaacatcgtcgaatcagaaatcgacgacaacaaaatcttccttgcccacgtcgcacagcgggcagcgccagtcggcgggaatgtcggcgaaacgggtgccgggtgcgatgccttcgtcgggcagcccttccgcttcgttgtagacccacccgcaaatcaggcagacccagctctggtattcggttacttcgctcatgtggcgctcggtaaaaatggaaatccggtgatgccgtccgcggcctggccggcggacgaaaggcgcaatggtaccggaatttcgccgaacggctccgcaacgtcgttttaaacgtacgcatcgcgaacaacacaactggaccacacgtgccgtacgtgcggtgtatgcttcccgggctgtccaaccataaggagaatgcgatgctgaacaaaaagtggatcgcgagtgcggtatgcgtggcggcgatggccgtgtcgacggtcgcgcgggccgaggcgcgcgtgttttcgaagcgccgagagacggcgcgacggtgtcgaatccggtgctcgtgaagttcgggctcgaagggatggcgcttcggcccgccggcgacatgacgccggataccggccatcatcatctgctgatcgacgggcggccgattccgaagggcgacgtgattcccgcaggcgaacgttcgctgcacttcggcaaggcgcagaccgaaaccgagctcaggctgccgccgggccagcacacgctgacgctgcagttcggcgacggcgcgcaccgctcgtacggtcccgaaatgagctcgacgatctccgtgaacgtcaagtaagcacgcatatccgcgagggcggccgggccgtcctcgcgacggagtgagcccgcgccgcgggtgcccgccgcacgcgcggcactcgacctccggcaaccggcccgcgcgagcggtcctgcaccttatccgtccggccataccggtgccggcgcccgcgaccggtacaatgggcgcttccgatttctctcttcgccgtctccccatgtcgctctattccattaccggcgcgcagctcgcgttcggtcacgtcgcgttgctcgatcacgcggatttctcgctggaagccggcgagcgcgtcggcctgatcggccgcaacggcgcgggcaagtcgtcgctgctgaagatcgtcgccgggctcgcgaagcccgacgacgggctggtcacgcgccagcaggagctcgtgaccgtctatgtgccccaggagcccgagttcgagccgggtgcgacggtgttcgatgcggtcgcgtcggggctcgcgcacacgcgtgaagtgctcgaagaatacgattcgatcgcgcaccgcctcgcggatacgcccgaaggcgccgaacacgatgcgttgctcgcgcgaatgaacgcgctgcagtcgtcgctcgacgcgcacgacgcgtggaactggcgcacgcgcgtgtcgatgacgctcgcgcagatcggtctggcggacgtcgacgcgcgcgtcgacgcgctgtcgggcgggatgcagaagcgggtcgcgctggcgcgcgcgctggtgctgcagcccgacgtgctgctgctcgacgaaccgaccaaccacctcgacttcgacggcatccgctggctggaagagctgctcgtcgcgcagcgcgggcctgctgttcatcacgcacgatcgtgcgttcctcgaccgcgtcgcgacgcgcattgtcgatctcgaccgcggccggctgttgtcgtatccgggcaatttctcggcgtaccagacgcgcaaggcgcagcagctcgaagtcgagcgcgtggaaaacgagaagttcgacaagctgctcgcgcaggaggaagtgtggatccgcaaggggtcgaagcgcgccgcacgcgcagcgtcggccgcatcgcgcggctcgtgcagatgcgcaacgagcgcgcggagcgccgcaattcgcagggcaacgtgaagctcgacgtcgcgcagggcgagaagtccggcaagatcgtcgcggagctgaccgacgtgacgaagcgctacggcggccgcaccgtcgtcgatcgcttctcgacgacggtgatgcgcggcgacaagatcggcttcatcggcccgaacggtgccggcaagacgacgctgctcaagctgattctcggcgaactgaagcccgacgaaggcacggtgcgcaccggcacgaacctgcaggtcgcgtatttcgaccagatgcgtgcgcagctcgaccaggaaaagagcctcgcggataccatcagccccggcagcgaatgggtcgagatcggcggcgtgcgcaagcacgtgatgagctatctcggcgatttcctgttcgcgccggagcgcgcgcgttcgccggtgaagtcgctgtcgggcggtgagcgcaaccggctgctgcttgcacgcctgttcgcgcgtccggccaacgtgctggtgctcgacgaaccgaccaacgacctcgacatcccgacgctcgaactgctcgaggagctgctggccgactacgacggcacggtgctgctcgttagccacgatcgcgcgttcctcgacaacgtcgtgacgtcggtgatcgcgtccgagggcgacggcaagtggcgtgaatatgtcggcggcttcaccgactggcagatccagagcgcgcgcgcggatcagctcgcgcagcaggaagccgcgaagcgtgcggtgaaggaagcggcgcccgtcaaggaggagccggcaaaaagcgccgcgggccgcaatgcgcagcgcacggtgaagctgtcgttcaacgagcagcgcgagctcgattcgctgccggagaagatcgccgcgctcgaagaggaacagaggacgatcaatgcccggctcgaagacggttcgatcttcgcgaaggatccgcaggaaggcacgcgcctgaccgagcggttcgcggcgatcgacgacgaattgctcgcggcgctcgaacggtgggaaacgctcgaggcgaagcgcaagccggcgtaatccgcatgacgcgtcgcgcggccggcggcggccgcgcgcgattgcgcgattggcgcgccacgcggaaccagtaaaataccgcgcgtcccgggcagcgcagccaacgccgcgcgcccgctttcggagcagtccaagcacaccgttgtttcgattcgctttttacggaactcaacgttttgtccacgacgttatccacacgaggtgtggacaacgtcccgatgaatgacgaaattcagcgcctatgtcaacgaagaaacccagcgcggcctatagcgaagcatcgatcaaggtgctcaagggtctcgagccggtcaagcagcggcccggcatgtacacccgtaccgagaatccgctgcacatcatccaggaagtcatcgacaacgcgtccgacgaagcgctcggcggctacggcaagcagatcacggtcacgctgcatgccgaccagtcggtctcggtcgaggacgacggccgcggcatcccgttcggcatgcacccggaagagggtgtgccggtcgtcgagatcgtattcacgcgcctgcacgcgggcggcaagttcgacaaggccgcgggcggcgcctatacgttctcgggcggcctgcacggcgtcggcgtgtcggtgacgaacgcgctcgcgacgcgcctcgacgtcaccgtctggcgcgacggcaagatcgcggaactcggcttcgccgaaggcgatgtggtgaagccgctcacgacgcagggcgcgggccgcggcgaaaagaagtccggcacgcgcgtgcaggtgtggccgaatccgaagtacttcgactcgccgaacctgccgctcggcgagctacagcgcctgctgcgctcgaaggccgtgctgctgccgggcgtcgaggtcgtgctcgtcaacgaaaagagcggcgagcgccagacgtggaaatatgaagacggcctgcgcggctacctgctcgacgaaatgaacggcagcgagttgctgatcccgttgttcgaaggcgagcgtttcgccgattcgcgttcgggcgacgacaccttcgccgaaggcgagggcgcgtcgtgggtcgtcgcctggagcgaggaaggttcgctcgtgcgcgagtcgtacgtgaacctgatcccgacgccggccggcggcacgcatgaatccggcctgcgcgacggtctctaccaggcggtgaaaagcttcgtcgaactgcacaacctgcagccgaagggcgtgaagctgctcgcggaagacgtattcgcgcgcgtgtcgttcgtgctgtcggcgaaggtgctcgatccgcagttccaggggcagatcaaggagcgcctgaacagccgcgacgcggtgaagctcgtgtcgtcgttctcgcgtccggcgctggagctgtggctgaaccagcacgtcgagcacggcaagaagctcgccgaactcgtgatcaagcaggcccaggcgcgcacgcgcgcgggccagaaggtcgagaagcgcaagagctcgggcgtcgcggtgctgcccggcaagctgaccgactgcgagaccgaggacatcacgcgcaacgagctgttcctcgtcgagggcgactcggcgggcggttccgcgaagatgggccgcgacaaggaataccaggcgatcctgccgctgcgcggcaaggtgctgaatacctgggaaaccgagcgcgaccgcctgttcgcgaacaacgaggtgcacgacatctcggtggcgatcggcgtcgatccgcacagccccgatgaaagcgtcgacctgtcgaacctgcgctacggcaagatctgcatcctgtcggacgcggacgtcgacggctcgcacatccaggtgctgctgctcacgctgttcttcaagcatttcccgcaactgatcgagcgcggccacgtgtgcgtcgcgcggccgccgctgttccgcgtcgatgcgccggcacgcggcaagaaggcggcgcagaagctctatgcgctcgacgagggcgaactggaagcgattctcgacaagctgcgcaaggacggcgtgcgcgagacgcaatggagcatcagccgcttcaaggggctcggcgaaatgagcgccgagcagctgtggataccacgatgaaccccgacacgcgccgcctgatgccggtgaagctcggcgaactcgactacgaggcgaccgtcgcgcgcatgacgatgctgatgggcaagggcgaggcagccgcgcgacgcggctggctcgaggaaaagggcaacgacgtcgaagcggacatttaagccgggaatccgcgcggccgggcatgacgcccggcccggcctcacgccacttacgaatacggaattcagatggacgacaacacctccgatctctttgccgactccggcgcgccagagagcgatgcgctgacgctcggcaactacgcggagcaggcgtatctcagctacgcggtcagcgtcgtgaagagccgcgcgctgcccgacgtgtgcgacggccagaagccggtgcagcgccggatcctgttcgcgatgaacgaaatgggcctcggcccggacgcgaagccggtgaagtcggcgcgcgtcgtgggcgatgtgctcggtaaataccacccgcacggcgaccagtcggcgtacgacgcgctcgtgcgtctcgcgcaggatttctcgctgcgctacccgctgatcgacgggcagggcaacttcggctcgcgcgacggcgacggcgcggcggcgatgcgatacaccgaagcgcggctcacgccgatctcgaagctgctgctcgacgagatcgaccagggcacggtcgacttcatgccgaactacgacggctcgttcgaggagccgaagacgctgccgagccgcatgccgttcgtgctgctgaacggcgcgtcgggtatcgcggtcggtctcgccaccgaaattccgtcgcacaacctgcgcgaggtcgcggcggcggcggttgcgttgatccgcaatccgaagctctcgcacgcggagctgatgaacctgatccccggcccggatttcccgggcggcggccagatcatatcgagcgacacggaaatcgcggcggcctatgaaaccggccgtggcagcctgaaggtgcgcgcacgctggaagatcgaggatctcgcgcgcggccagtggcaactggtcgtcaccgagctgccgccgaacacgtcgggccagaaggtgctcgaggaaatcgaggagctgacgaacccgaagctcaagctcggcaagaagacgctcacgcccgagcagctcaacacgaagaaggcgatgctcgacctgctcgacgcggtgcgcgacgagtcgggcaaggaagcggcggtgcggctcgtgttcgagccgaagtcgcgcacgatcgaccagacggaattcgtgaacacgctgctcgcgtacacgagcctcgagtcgaacgcgacgctgaacctcgtgatgatcggcgccgatggccggccgggccagaagggcctgctgacgatcctcgacgaatgggtgaagttccgccagctgacgatgacgcgccgttgccgccatcgtctcgcgaaggtcgacgaccgcatccacatcctcgaagggcggatgatcgtcttcctgaacatcgacgaggtgatccgcatcatccgcgagtcggacgagccgaaggccgcgctgatgagcgcgttcggcctcagtgaacggcaggcggaagacattctcgaaatccggctgcgccagctcgcgcggctcgagaagatcaagatcgagaaggaactcgaagcgctgcgcgacgagaaggcgaagctcgaggaactgctcgcgaacgaaagcgcgatgaagcggctgatgatcaaggagatcgaggccgacgcgaagcagtacggcgacgatcgccgcacgctgatccagcaggaaaagcgcgcgacgttcgaggcgaaggtggtcgacgaaccggtgacggtggtcgtgtcgcagaagggctgggtgcgtgcgctgaagggccacgggctcgatccggccggcttcacgttcaaggccggcgaccatctgtacgcggcgttccagtgccgcacgccggatcgcctgatcgcgtggggcagcagcggccgcgtgtactcggtcgacgtgtcggtgctgccgggcggacgcggtgacggcgtgccggtcacatcgctgatcgagctcgaatcgggctcgcacctgatgcactactacgcggcgccggccgaccagcaactgctgctcgcgtcgagcaacggcttcggcttcctcgcgaaggtcggcgacatggtgagccgcgtgaaggccggcaagtcgttcatgaccatcgatgcgggcgcggtgccgctcgcgccgatgccggtgctgccgaacgcgacgcaggtcgcgtgcctgtcgagcggcggccgcctgctggtgttcgggatggacgagatgaagacgctgtccggcggcggtcgcggcgtgatcctgatggcgctcgacgacaaggaaacgctcgttcaggcgctcgcgatcgatccggccggcgtcgtgctgatcggtaccggccgcggcggcaaggcgcaggacgagacgctgtcgtacgcggggctggcgccgcacgtcggcaagcgcgcacgcaagggccgcgcaccggagacgaagctcaaggtcgtcaacgagctgcgtccgctgctcggctgacgcgacgcacgatcggccggccggttcggccgcgatcgaaggccgcacctccgcttcggcgggcgtgcggcctgtttttgagcgggcattcgggtaagcaagcgtggcgctgtcacgcggaacttgcaaaatagtgtgaaatcgcgcctggggtctgaaccgggcggcgacaatccggtcgaacgtcgctcgatgccgcgtgcgacgcggccgttcgccgtaccccactcctcacaggattgccgtcatgtcccatgctgtctccgtcgcgctgtttcttcatctgctggccgtcgccgtgtgggtgggcgggatggtcttcgccaacttctgcctgcgtccggcgctgtccgacctgtcgccgcagcttcggttgccgctgatcgaaggcgtgttcggccgcttcttcaactgggtgtcgggcgccgtgatcgtgatcctgctgtccggcggcttcctgctcgtggaattcggcggcgcgcacgcaacgtggtcgctgcacgcgatggccgggctcggcgtcgtgatgatgctgatcttcgggcatatccggttcgcgctgttcccgcgcatccgtcgtgcggtgcaggcgcagaagtggccggacggcgcgcgcgcggtgaatacggtgcgcctgctcgtcctcgtgaacctcgtgctcggcgtcgtgacgatcggcgcggcggtgttgtcgcgcggtttctgacctgtcggtgccggccggcgcgcagccgccggcgcatcggcctgcgtcgctacgcggccagcatcgcatcgagcagccatgagccgaccgggccgagcggccggttgcgcgaccagaccgcatcgacccgcacgcggcgcggccagccgcgcgcacgcagttcgcacaggcgatcgcgcgcaaagtggtcgaccatccagcgcggcagttcggcccagccgaacccctgcacggccatctccagtagcatcaggtagctcggcgccagccagtggtgcgtgccgacgacgatccggtcgccggtgccgcgaccttccggtttcacataggtattgaggcgcagttcgcgcacgtcgcgcagcgcggcgtgcggcacgtcggcgtcgccgtattcggcgagcgcgtgcatgcggccgacgaacagcccgatctccgattcctccgcgatcgtcgccgcgccgatgtcggccgggtaagccgcgcgcgcggccatcagcccgagctgcgcgcgtccctgctggatcaggtcgagcacgtcgtcgtgctcggcgatctggcattcgaactcgagcgccggaaagcgccgctcgagcgccatcaacgtttcctcgtagcgcttcgactggtacgtatcggacacgacgagcgtcagccgcgcttcctcgccgcgcgcgagccgcgcggccgtgcggtcgattgccgcgccggcctcgagtgcgcgctgcacctgcggcagcagcgcccgcccggcgtcggtcagcgtcggcgtgcgcgtcgagcggtcgaacaactgcacgccgagatcgatctcgaggttcgcgatcgcctccgacacggtcgactggcgcttgccgagcttgcgcgaggcggccgtgaacgagccgagcagcgcggcttcggcgaatgcgagcagggcttcgggggcgtggcgcatgcggcgctcctgatggcgttgtatcggaaaaaccgatgatatcaaactggattcatacggttgtgccgatcaaaatggctgccatcaacgaagcagacgaatcggagggaatcatgaaacaggtcaacaaaacggtgacggaacggttgctgcatgcactgacgttcgaactggtcgcgatcgcgctgtgcgcgccgctcggcgcgtggctgctcgacatgccggtgtcgcacgtcggcgtgctgacggtgatggtgtcgctgatcgcgatggcgtggaacatggcgttcaatacgctgttcgaccgcgtcgagcggcgcgcgggtggtcgcgcacgctcggcgtgcggatcgcgcatgcggccttgttcgagctcggcctcgtcgtgctggtggtgccggtcgccgcgtggtggctgaacgtgagcctcgtcgaggcgctgctgctcgacctcggtatcgtgctgttcttcctgccttacacgttcgccttcaaccttgcgtacgacgcgctccgcgcccgctggatggcacgccgggtcgcggtgcaggcggggtgaggacgggcgaatgccggtcaaggctgacgggcggcggccgccgcccgtcagcgcgcggcggcccacagccacacgccgcacgcaaccgcgaccgtgccgtacacggcatagacgggcaccttgaagcgcgcgaagcaaagcgtcgcgaaggcgcccgtcagccagtaaacggggtcggccggttcgcggtgcaggatcctcacgacggcgacgacgagaaaacccgtggtcgccgcgcgcagcaggcgcatcccgtgctcgaaacgcgaatggcgcttgagccgggacagatggttctgcgcaaacacgacgaggcagcccgacggaatgaacagcgcggccgtcgcgagcagcgcgccgacccagccgtcggtcaggtagccgagaaacggcacgacgttcagcagcggcccgggcgcgacgggcgacagcgcgaacgcaagcgtgaagtcgtgatcggagatgccggttgccggcgtgacgaacagcgtcttgagcacgggcagcgcggaaaagccgccgccgaacagcgtcatgccggcgccggcgaggcgcggccacagcagcgtcgcctggtaatcgccgggcagcggcaccgcgaacagcgtgacgagcacgccgagcagcacgagcaggttgcggtcgcgggccgacagcgtgaaatcgaccgcgtcgcgctgcggcggcccggtcagccagcccgccgcgaatgcggcgaaaagaatcccgacgaaagcggccggattatgcgcgaaagcaagcagaatcgtcgacagcgcggcgatcagctgttcgccccgtgtgcgcgcgagcgagcgcaactgcttgacccacgtgacgccgatcagtgcggcgagcaccatcgaagtgattgatcagcatcggcgccgccagcgagcgcacgaatggcgtgcgatagaagatcgcaaacagcgtcatcaggatggagaagggcagcacgctcgcgatgccggcaacccatgcgccgacgcggccatgcagtatctggccgacctgtaccgccacgttgcagcctacggggcccggcacgagccaggccagcgcgacgagatcgccgaatacgtgaggctcgatgcgctgcaaccgctccacgtagtggcgttcgagttgcgccatcatggaaagcccgccccacgagaccgccgaaatgctggcaacgaccttgaacaggtcccacagggaagcctgtgcctgttcgacatcagcggtcgcttcgatttcgacggttgtcatcttggtagtgtgggctcggggcccgatctctcgcgtatggccatgccggcggcccgccgacacgttgcccctcccgattgtccgccgcgcatcgtgacacgaccatgagcgaaaacgctagttcatgaaccgaacaatcggatcggaaaacgaaacaatgacggcgcacgcaacgcccgccacggctacggtgcgcttacgcgcccgtgctgcccgtcgcgcggtgcgcgatcacgttcggtgaatcgctgcgcacgccgaagcgtgcgatcagcgcgggaatcgcatcggccggcaccggtcgcgagaacaggaagccctgcgcctcgatttcgccgagcgcggacagccacgtgatctgctcctcggtttccgtgccctcgacgacgacggtcagcccgagcgagcgcgcgagatgcacgatcgacgacaccatcacgcacacgctgcgatcgttcgggatcgcctgcacgaacgagcggtcgaccttcagcgtgtcgacggagaagcggtgcaggtacgacagcgacgaatagccggtgccgaaatcgtcgagtgcgatccggataccgagtttcttcagtgcgacgatcttctcggacacgagctccggatattccatcatcgcggtttcggtgatctcgatttcgagccggttcgcgtcgatgccggtttcctgcagcgtgctcgagatcgtctcgatcaggtcgccgcgccagaactgcaccggcgagatgttgaccgcgagcgtcagcgtatcgtggccctcgtcgcgccagcgcgcgatctgctcgcacgcggtgcggatcacgaagtcgccgatcggcacgatcaggccggtcgattcggcaatcgaaatgaattcgttcgcggagatgatcccgtgctccgggtgatcccagcgcgcgagcgcctcgaagccggtgatgtggcggtgcgtgaggtcgatcttcggctggtatgcgaggaacagctgcccctcggcgagcgcgacgcggagttgctgctcccagcgcatcaggtggtcggcgcggtgcgacaggtgcggcgcgtagaactggtagcagttcttgccggcgtccttcgcgctgtacatcgcgagatcggccttcttcagcaggtcgatctcgctttcgttcgcgaccgtgtgcagcgcgatgccgatgctcgcgtgcaggacgaacgagctgccgcgcacgtcgaacggctcgctgaacatccggatgatcgcttccgcgagccgcaccgcgcgccgctcgacgtcgtcgcccttcatcacgacgacgaactcgtcgccgccgatccgcgcgagcgagccttcgtcgccgaccgcatcggccaggcgcgacgcggtcatctgcagcacgatgtcgccggcgttgtggccgagcgtgtcgttgacggtcttgaagttgtcgaggtcgatgaacagcagcccgagccgcgacaggctcgtcggcatcgacacgtcgttgcgcagcccgcgcagcgtcgcatagcggttcgcgaggccggtgagcaggtcgtattcggcgagctgcgtcatttcccgctcgcggccgagcagcttgccgatcagccccgtcgcgacgccgaagaacgcgagcatcgcgagcgtgatgaagctcgtcatcagcaggtagacgttgcgcgtgtggtagtagtccgcgaattcctcggtctgcgacagcccgaccatcaccgcgagcgggtagccgtcgaggtggcggtacgacacgatgcgcgtcacgccgtcgatcgggtcgatgatcgtgcccgtcacgcgctcggcgatcgggtagacgcccgacgccgaaaacgcgcccggcgcgttgctgaccgagcccgtgcgccgcgcgagcacgccgcccgtatcggacacgaccgcgatcacgccttccttgccgatcgccgcgttgttgtagaagtcgttcgtgaagtagctcgggtcttccgacacgacgacgatgcccgcgaagctgccgtccgggttgttcaggcggcgtgtcatctgcagcgtccagtggctcgatacgcggccgagcacgggcttgctgatgaagaggcggtcgtcgttgtgcgcgaggtggaccttgaagtgctcgcggtcggacaggttgatcggctgcggatgcagctcggccgtgttcgcgaacaggatgcccttcgcgttgacgagcgacacctggatcagcgtgtcgctcggcacgacgcctttctcgacggcgctcgcgaggttgaagcgtgcggggacttctcgaattcgaacttgacgaagcgggtgatctggtcgacctggtggatcgccttgaccgtatgctgctcgagcgcggaggacaggatcgccgcggaagccgccgcctccttgtaggcgctgtcctttccaccgagagacgcgcgatgatcacagcccacagcagcgcaagcgccagcatcccgagcagcgggatcgcaaatagcgcacgccggcgcgatttgcgcggcgcgcgaagcggccgggtcggcggcgtgtggttggaccgggcggagctcatcgaagagggtggcgtcctgctcgcgtgcgccatccgtcaggatggctggctatggttcgggttgtcccgacgtctgttcgttcgcgggacacgcaaccatggacagacctcgaaacaacggattaggcccgatattactggctggaacgtttttgcgatagttgggcgaagcgtaggggcgccgggcgggccggcgccatcgcacatcgcgaaatgtcacacgggtgacaggaaggtgccgtcgacgaccgtgacgacatggccgccgatccaggtggtgccgtcttcggcatagctgacgaagatgcggccgtctcggccgatcgccgtaccctggcgggccgtatcgacgggccggggcggcgctcctgccgcgtcagcagccccgccagcgcggcgtttgcgctgccggtgacgggatcctcgccgaagccgaagttgccgcccgtcatcaggcagcggatttcgaacgtcgcgggaccgccttcggcgtgcggtgcgtagacggcgaggccgtccatgccgtaacggtgcgtgagcgcctccagcgcggccggatcgggcgacaggccgatgcacgcgtcggccgacttcagccgcacgaccagccacggcgcgccgttgtcgaccgcgcacggctcggcttccaggtcgatcgcgtcgctgcgcagcgcggcagccagcgccgcgtagtccgaacggtcgagcggcgtgacgcgggccggcggcgcggcgaacgcccagccgtcggcctgctcgcgcagcgcaaccaggccgaccccgcactgctggatcagccggcccggcgtacgcggccgcgcgccgctttccaggaacgcatgcgcggtgccgagcgtcgggtggccggcgaacggcagttcaccggccgtcgtgaagatccggacgcggtaatcggcttccggatcggtcggcgtgcagacgaacgtggtttccgacaggttcgtccagcgggcgatctcgagcatggcgtcgtcgccgagcgagtcggcgtcgaacaccacggcgagcgcgttgcccttgaacggcaccgacgtgaacacgtcgacctgcttgaagcggacgagacggccgggcactgcgttgcgcccgttacgcaacttcggcgatcagctcgatctcgacgcacgcgccgagcggatctgcgcgacaccgaaagccgagcgtgcgtgcttgcccgcgtcgccgaacacttcggcgatcagttccgacgcgccgttcgtcacgacgtgctgttcggtgaagtcgagcgtcgagttgacgaggctcatcagcttgacgatgcgcgtgaccttgttcaggtcgccggtgtgcgcgtgcagcgtcgcgagcaggtcgatcgcgatcgagcgcgcggccgccttgccgtcttccgtctgcagatccgcgccgagcttgccggcccagaccttgccgtccttcttcgcgatgtggcccgacaggtagaccgtattgccgctttgcgcgctcatcacgtaggcggcggccggtgcgccggcggtcgggagctcgatgccgagcgacttcagcttgtcgtagacgttagccatggattcgattcctcgtagagagtcgtgacaggaaaaaggggatcagaggcgctcgcgcagcacgccgaggcgagcgacgccttcctcgatcttctcgggcggcaccgtcacgaacgacaggcgcagcgtgttctgctgcgcgttgtccgcgaagaacggcgcgcccggcacgaaggcgacgtggttgtcgacggccgcggcgagcagcttcatgctgtcgatctgcgcgggcaggttcacccagatgaacatcccgccttccggccggttccacgtgacgccttccggcatgtggcgctcgagcgagccgagcatcgcgtcgcactgcgcgctgtacagctcgcggatcgtcgggatgtgctcgtcgaggaaaccgtccttgatcacttcgtgcgcgatgcgctgcgtgagcgtcggcgtgtgcaggtcggtggcctgcttggcctgcacgagcttgaagtggagttcctcgggcgcaatgatgtagccgatccgcaggcccggcgcgagcaccttcgagaacgtgccgaggtgcacgacgtgatcgggcgccatcgacagcatcgtcggcagcggctcgccgcggtagttcagcgcgccgtacggatcgtcttccagcaccgggaacgggctcgactgcgcgaacgcggcgagcgcgcggcggcgctcgacgggcaggcggcggccggtcgggttctggaagttcggctgcgcgtacagcaggcgcgcgccttgcgtgagttccggcgtcaggccttccggcagcaggccctgctcgtcggtcggcacctgcacgtagcgcggctcgtacagcgagaacgactgcagtgcgccgaggtaggtcggggtttcgacgaggatcgggctgcccggatcgacgagcgccttgccgagcaggtcgagcgcctgctgcgagccggtcgtgatcagcacctgcgacacgcgcacgctgtagcgctcggcgatccattcgcgcagcggcaggtagccttcggtcgcgctgtactggagcgcggcggccggcgcgtcgcgcagcacgcgatcggcggcggcgcgcatgcgttcggccgggaacgtcgcgggggcgggcaggccgccggcgaacgagatgacctcggggcgttccgtgaccttcaggatttcgcggatcgcagagctcgtcagcttgcgggcgcgttcggaaagctgccagtgcggcggatgcaggtcgctcggattcatagtctcctcgttcggatatcgtggtcagtcaagaaaggtcgttcgggcaaatcgcttcgacgctgccgggtgggcatgcgcgagcgcgatcgagccttcgcggccgggtgggcaaaaccgatcaggcaaaacgtccattatggcgcacctgttcagccggcgcgagccggttgcgcggccgtggcgaccgccgagcggcgcccgagcaccacggtggcgatcaccgcggccgcgaacagccacgtggacgacgtgaccgtttcgccgaacagcagcgcggaaaaggcgatcgtgaagaaaatctgcaacagttgcacctggcccacgcgcgcgatgccgcccatcgcgagccccgcgtaccacgcgaaaaagccgatgaattgcgaaaagggtcacgtagccgaaggcgagccacgtgcgcagggcgagcgggcccggatgcgcggcatgctgcatccatgcgagccagccgaccggcagcacgaggaacggcgcggacacgacgagcgcccagcagatcacctgccagccaccgatctggcgcgcgaggcgcgcgccttccgcataaccgagcgcgccgatgccgaccgcgacgagcatcagcgcgtcgccggcctgcacggtgccgccgccgtcgcgcagcgcgaacgcgatcacgagtgcgctgccggccaccgcgctggcccagaacgccttcgacggccgctcgtgcgacagccatgccgcgtacagcgcgacgaacagcggctggaggccgttgaccactgcgccgtgcgacgccggtaccgatttcatcgcccacgcggagaacaccggatacgcgatgatcacgcccgccgacgtgatcgcgaggcttttcagttgcgcgcgggtcggcagcggctcgcggcgccaccacagcagcaggccggccggtacggcggcggcgagcgcgcggccgagcccgttgagcagcggatggagttcggagacgacgatccgcgtcatcggcagcgtcaggctgaagatcatgacgccgatgaggccgagcagcatgcctcgggtttcgcgcgaattcatggggtaagtgtctccgtgttgccggtattggggtggggtcggggcagcggggctcagcgcagcgtgcgcgggccctgcggcgtgtcgaattcggcgacgagcgcgggcgggccgtcggcggcttcgaggtcgagcagatgggcggcgccgagccagtcgagctgctcgcggacggcgtcggcacgcgggtgggtgcccttgagcgccttcagcgcgatgccgttatccggcagcgactcggccgggtggcgcgggctgtcccactggatcagcgacggcacgagcccgtcgcccgcgccttgccacgcggggaatgcgccgtcgtcgggcacggtgaggccccagctcaggtcgccgcgccgcatcgcgacgaccggcgcgatgcgtgccgggtactggctctgccacagcgcgagctggcgcggacggtcgacgcgcgcgacccagtgcgcgagaaacgggccttgcgcgagccgcgcttgcatggccggctcgtcgagcgcgaacagccgggcgcgcggcggctcggcgccgtcgttcggcgccggcgcgtcggggtcgatcgcgatcacctcgagatacagcccgccccacgcgccgaacagcgcattgtgggttcgcatcagcgggtggcggccgccgccggccggttcgatgccgagcgcgtcggcgacatggcgtacgccttcgtcgagcgtgcgcgcggcgatcacgagatggtcgagtgtcagggagcgggctggcatgaacgtcggtcgggaagcgaaagtgtcatggtgggcaggcgaggcgccgggcggtggccgaaccggccggcgtaccggccgcgatgcgggccggtgggcgctgtgccgggtgcggcgctgccggaacggcggccgcacggtcgccagtccggtcaactgtaatcgtcgctaccggcacagtaacggtacaatcggcgcgatagccttcggtacagttggagctgccgcccatgtccaccgtcccactcgcccagattcccgcgccgcacgatacggccacgctcacgctcgtcgaccagctggtccagtgggcgcggcggcgtatcgacgaacgcgtgttccggcccggcatgcggatgccgtcgatccgcaagctcgcgctcgacaagagcgtatcccgcttcaccgtcgtcgaggcctatgagcggctcgtcgcgcagggttatctcgactcgcggcgcggctcgggtttctacgtgcgcgagcgcacggccgccggcccgcagccggccgacagcgttgcgcgcgtggccgaggccgcgccggtgcacaacacgatcgacgtcgtctggctgctgcgcaacatgctgcacaccgtcagcccggaaaagggccgggtctcggctatctgccgggccgctggctcgacggcgaactgattaccggcgcgctgcgcgcgctcgggcgccagtccggcgcgcagatgctcggcttcggcaccgcgcagggcttcctgccgctgcgccagcaactgcagacgcgcctcgccgaagtggagatcggcgcgaaacccgagcagatcgtgctcgtctcggggatcacgcaggcgatcgacctgatttcgcggatctacatgcggcctggcgacgcggtgatcgtcggcgatccggcctggttccagatgttcgggcgtttcgcggcgcagggcgcgcaactcgtcggaatgccttacacgcccgacggccccgatctcgacgcgctcgaaaccctggtgcagatgtggcggccgaagatgctcgtgatcaactcggtgctgcagaacccgaccggcacgtcgctgtcggccgcgcaggcgttccggatcctgaagctcgcggaggcgtacgacttcctcgtcgtcgaggacgacgtgtacggcgacctgtgcccgccgagttatccggccacgcgcctcgcgagcctcgaccagctgaagcgcgtgatctacctcggcagctattcgaagacgctcgcggcgaacctgcgggtcggctatgtcgcgtgcgcgccggagatcgcgaaggcggtcaccgaccagaagatgctggtcgggatgacgacgcccgagctcaacgaacgcgtgctctacaagatcctgaccgaagggcattaccggcgccacgtcgagcggctgcgcgcgcggctcgacggcgtgcgcgacaagaccgcgcggatgctcgagcgcaccgggctcggcctcttcacgatgccggcggccgggatgttcctgtgggccgacacgggcgtcgactccgacgcgctcgcggcggtcgcgcacgaggccggctttctgctgacgccgggcagcctgttttcgccgcagcaatcgccgtcgacgtggatgcgcttcaacgtcgcgaactgcggcgatccggcgctgccggggctgctgtcgcgctatatcgattcggccgtacgccgcgcgtcgtgacccggcgcggcacgccggcccttgaaatcgggcgtgcgatccccagatacgcgcgcaaaccgcttgcgccaggcggtggcccttcagggccgtccggcatcgcgcgccgggcgcctgcgccacaccattcaagttcaagtaagaggaaacagcatccatggcacatgaaacgatgagctttcaggcagaggtcaagcaacttctccacctgatgatccattcgctctacagcaacaaggaaatcttcctgcgcgaactggtgtcgaacgcgtccgacgcggccgacaagctgcgtttcgaggcgctcgcggacaacgcgctgtacgagaacgatccgaacctgcgcatccgcatcggcttcgacaaggccgcacgcacgatcacgatcgaggacaacggcatcggcatgagccgcgacgaggcgatcgcgaacctcggcacgatcgcgcgttcgggcaccaaggaattcttcacgaagctgtccggcgaccagcagaaggacgcggcgctgatcggccagttcggcgtcggtttctactcgggcttcatcgtcgcggacaagatcaccgtcgagacccgccgcgcgggcctgccggcgaacgaagccgtgcgctgggaaagcgcgggcgagggcgacttcacgatcgacgcgatcgagcgcgcgcagcgcggcacgacgatcacgctgcacctgcgcgaaggcgaggacgagctgctgtcgtcgcaccgcctgaagtcgatcatccagaagtattccgatcacatcgcgctgccgatcctgatgcagaaggaagagtgggatcaggaaaagggcgagatggtcctgaaggacgaggacgagaccgtcaaccaggcgagcgcgctgtggacgcgttcgaagagcgacgtcaccgacgagcagtacacgcagttctaccagcacatcgcgcacgaccaccaggatccgctcacgtggacgcacaaccgcgtcgagggccgcagcgaatacacgcagctgctgttcgtgccggcgcacgcgccgttcgacctgtggaaccgcgactaccgcggcggcctgaagctgtacgtgaagcgcgtgttcatcatggacgacgccgagcagttgctgccgcaatacctgcgcttcgtgaagggcgtcgtcgattcggccgacctgccgctgaacgtgtcgcgtgaaatcctgcaggaaagccgcgacgtgaaggcgatccgcgaaggcgtgaccaagcgcgcgctgtcgatgctcgaggaactcgcgaacgcggaagaggatgccggcaaggagaagtacaagacgttctggggcgcgttcggccaggtgctgaaggaaggcctcggcgaggatcacgcgaaccgcgagcgcatcgcgaagctgctgcgcttcgcgtcgacgcacggcgacaccgacgcgcaggacgtgtcgctcgccgactacgtgtcgcgcatgaagcccgagcagagcaagatctactacgtgacggccgatacgtggcaggccgcgaagaacagcccgcaccttgaagtgttccgcaagaagggcgtcgaggtgctgctgctgaccgaccgcgtcgacgaatggatgctgtcgttcctgcatgaattcgacggcaagccgctcgcgagcgtggcgcgcggcgacctcgatctcggggagctgaacgacgaagagaagaaggcgcaggaagaagcgggcgaggcgatcaagcccgtcgtcgagaagatgaaggaagcgctcggcgacaaggtgaaggaagtgcgcgtcacgttccgcctgaccgattcgccgtcgtgcctcgtcgccgacgacaacgacatgagcggctacctgcagcggatgctgaaggcggccggccagaatgcgccggcgatgcagccgatcctcgagatcaacccggagcacgcgctcgtcaagcaactgaaggccgacagcgccgatttcggcgactgggcccatctgttgttcgatcaggcgctgctggccgaaggcggcatgctggacgatccggcgagcttcgtgaagcggaccaacgcgctgctgctgtcgcgcgccgcgtgaacgcgcgcttgcgattcgacggcgggcaggccggctggcgcgagacgccgcggcctggctgcacgctcgaccagcgcgactggctgacgcgcggcggatcgctgaccgcgcacctcgcgcggctcggccgcgtgaacgtgcgggtgacgcgcgaggccgtcgactgcccgtggttcgacgagccggacgcgctcgccagttcgccgcgcgcgccgatgtgggtgcgcgaggtgatcctgtcggtcgacggcacgcctttgttgccgcgcacagcatcgcgccgctcgcggccagcaagggcgtgtggcaggcaatgcggcggctgcgcacgcggccgctggccgagttgctgtacagcgatccgcaggtcgaacgttctgcgctcgtcagccggcgcgtgatcgccggccatccgttgtatgcgctcgcgagccatgcgctcggcgcgggcgtgcgcgcgccgcatgcgtttgccgcgcgacgctcggtgtttcagcgtcacggcaagccgttgatggtcaccgaatgcatgctgccggcgctgtggcgtcatctcgatgcgcacggcgacgggccccggtccgtcgggccgcgtggagtcgcgtgatgctgcaggggtttgcgccggtcgtcgggccggatacgcacacgatgatcctcggcagttttccgggcgaggcgtcgctcgacgccgcgcagtattacgcacatccgcgcaaccagttctggcggttgctggggcggtgctcggcgagccgacgcttcatgaactgccgtacgatgcacggctcgtgtgcgtgctttcgcatggcatcggcatctgggacgtcctcgatgcatgccatcggaagggcagtctcgactcggcgatccggaatgcgaagccgaacgacttcgattcgttgcgggaacatgcgccgttgctcaagcgcgtgtgcttcaacggcaagacggcagggcggttcgccgacgtgatcggccacgccggatacgacacgctcgtgctgccttcgtcgagtccggcgaatgcaatgttgtcgttcgagcagaagctcgcgcagtggcggcagattcgcgactgattgcggcgcgagggggcgaggcgggcagccatcgtgcgcgacgctcaatcgtcctcgccccatctccatctgggcttctcgcccttgatccagcacaccatggtcagcagcgcgaccagcaccacgatgcacacgccgtacgcgaacggtgaacggtgaggcggcgccagccatgcgctcgcgatgatcccgagcgcgaacagcaccagcacgacccagccctgccacgcaaccggcaatccccagccccatccgtagcgtttcgccggaaaccagatcttcctgttggttgaggtcatgtttcctccttcgagcgatgaatgccgtgtatcgccaacgggattcgaagtcgggtgcggccgggcgcgcctcgcggctgccatccccaccaatgctatcctctcgtccgctaaaaccagcgtcacccagcgagattcaatcatgacccgactgatcaagcgcgcgtccgccgaggcgcgcgcgttcaagaatcgcaagccgtcctcctataacggctccgaaaaactccagccgccgcgcgtgaagcgccgcccggacatcgacgaacacgacgacgtgcccgtgctcgaagcgccgcgcaagccgcgcttcgcgcccgtcacgttctcggaagagggcggcgtgcgcttcctgcatttcggcaccgagtgggtacagggtgcgatgcggatctcgaagccgctgcacatcgagctcgaatacgcgcagcagatgatggcgtggctgctgttcctcgaaacgcccgggcggatcgtccagctcgggctcggcaccggcgcactgaccaagttctcgcaccgcttcctcccgcaagcgaaggtcgaggctgtcgagctgaacccggccgtgatcgtcgccgcgcgcacgatgttcgcgatgccgcccgacgacgcacgtctcgtcgtgcacgaagccgacgcgtgggacttcgtcaacgacccggccaaccgcggcacgacgggcgcgatccagatcgacctgtacgacgcgaccgcgcgcggcccggtgctcgacagcgtcgcgttctaccgtgcggtgcgcggctgccttgccgacgcgggcattgcgacgatcaacctgttcggcgatcatccgagcttcgtgcgcaacatgaagcacctgaacgcggcgttcgatcatcgcgtgatcgcgctgccggaagtgcatgacggcaaccggatcgcgatcgcgttctcgggccccgcgctcgacgtgtcgttcgcgcagctcgacgcgcgtgcgaagctgatcgaggacacgctgaagctgcccgcacgcaagtgggtgaaagctttgaaagaaacgatcggcgcgcgcgatacctcgttcgcgatctgacgcttcaggcaccggcggcaggccggtgcaaccacgcggcaagggcggatcacctcgggttcgccccgcttgaccgcgtgctcgcggctcctatactggcgcgaagccagggagccgcagcctacccgttttgcgctcctctcggtgccgtacccgctcaacaagatcgataaccgggaaagaagaggagacgtcatggctcacgatgccgacgccaaccgggccgccaagcgctggctctggctgctggtactgccgttgatcgcgatggtctgggtaccgtcgtacagcaagatcgaaccgcaggtgttcggttttccgtttttctactggtaccagctgctttgggtcttcatcagcgcggtgatcaccgcgttcgtgtacttcaagaccaagaacgcgtggaaggcgagcggcccgcagggaggtgcacgatgaatctcggcgcaaccttcgtcttcgtcctgctgttcatcggtgtcacgatcatcggtttcctggccgcgaactggcggcgcggcgatctcgcccatctcgacgaatggggcctcggcggacgccgcttcggcacgatcgtcacgtggttcctgctcggcggcgacctctatacggcgtacacgttcgtcgcggtgcccgcgctcgtgttcggcgccggtgcgatgggtttcttcgcgctgccctatacgatcctgatctatccgttcgcgttcgtcgtgttcccgaagctgtggagcatcgcgaagcggcacggctacgtgacggccgccgacttcgtcaacgcgcgctacggcagccggatgctcgcgctcgcgatcgcggtgacgggcatcctcgcgacgatgccgtacatcgcgctgcagctcgtcggcatcgaagtggtgatcggcgcgctcggtttcgacacgaccggcttcgtcggcgacctgccgctgatcatcgcgttcgcgatcctcgccgcgtacacgtacacgtcgggcctgcgcgcgcccgcgatgatcgcgatcgtcaaggacatcctgatctacatcacgatcgccgcggcggtcatcgtgatcccggcgaagctcggcggctttggacacatcttcgcgagcgtgccgccggccgaagctgctgaaggcgcccgacgcgatgagcctgaacggctacagcgcgtacgcgacgctcgcgatcggctcggcgctcgcgttgttcctgtatccgcactcggtcacggcgatcctgtcgtcgtcgtccggcaactcgatccgccgcaacatggcgatgctgcccgcgtactcgttcgtgctcggcctgctcgcgctgctcggctacatggcgctcgcggcgggcgtgaaggacatgccgcagtacgcgccgtacttcaaggcgttcggcccgaacttcaggtgcccgcgctgttcctcgagtatttcccgtcgtggttcgtcggcgtcgcgttcgcggcgatcggcatcggcgcgctggtgccggcggccatcatgtcgattgcggccgcgaacctgtacacgcgcaacattcaccgcgagttcgtgaaccgcaacatgtcgcacgagcaggagacgcacgtcgcgaagctcgtgtcgctgatcgtgaaggtcggcgcggtcgcgttcatcctcgggctgccgctgacctatgcgatccagctgcagctgctcggcgggatctggatcatccagacgctccccgcgatcgtgctcggcctttacacgcgcgtgctcgaccatcgcggcctgctggccggctgggcggccggcatcgtgtgcggcacgtggatggcgatttcgctgaagctggccggatcgatcttcacgatccacctgttcggtctcgcgattcccggctacgcggccgtgtggtcgctgatcgtgaacctggtggtggcggtggtggtgagcgtgctggtgcgcgtgatgggcatggcgcatgcggaggatcgcacgcggccggaggactatctcgacgtcgtcgaaggctgagacggacgacgcgcggtaacgaaaacgcccgccaccgtgaggtggcgggcgttttcctgcgtcagccctgcgcgcgtttcgcgagctcctcgcgctgcgacaggtcttcgacgttgaccatccagtgcacgccgaagcgatccttggccatcccgaagccgagcgcccagaacgtcttgccgaacggcatcgtcacttcgccgccgtcggcgagcgcattgaacagcttctggccttcctcgaccgtctccgggttcagcgacagcgaataaccggcgtgcgcggcgcctgccggctggctgcagtcgccgtccgagcacatgatcatcgagtcgccgatcgtgaagctcgcatgcatcaccttgtcgcccatctccggcgccatcgggtagtcgggattcggcggcgcgtccttgaagtgcatcttgaacatcgtcttcgcaccgagtgccttttcgtagaactgaagggcttcgtcggcgcgaccgtagaacgtcaggtacggttgaacttgcatcgttgtctcctgtgatgagccggcctgcgcatctgcgcgggttcggcgtcgaacaagactgaccgggaaaagggggcatcgggaggcggccgccgcacccgtgacgtggattgtagtgcgcgtgcttgacgatggaatgaaaataaaaacggccgcgaacatgacgttcgcggccgtgtgcgtcgcgcttgctgacggctgttgtcagtgttgccgacagccgctgacgcgtattgcggctcagcgcagcgagtcgatcagcttctcgagcttcaccgcatcggcggcgaatacgcggatgccttcggcgagcttttcggttgccatcgcgtcgtcgttcagctggaagcggaacgctgcctcgtcgatcgcgacacgcgcggcgggcttgtcgtgcagcgcttccggcgacagcttgcgcgtgaccgtctcgttgctgtcctgcagctttgcagcaaatcgggactgatcgtcagcaggtcgcagccggcgagttcggtgatctggctggtcgtgcggaagctcgcgcccatcacttcggtcttgtagccgaacgtcttgtagtacgtgtagatgcggcgcaccgactgcacgcccggatcgttcgcgccaccgtccttctcttcattccactccgcgccggcctgcttcttgaaccagtcgtagatgcggccgacgaacggcgagatcagctgcgcgccggcttccgcgcaggcggcggcctgctcgagcgagaaaagcagggtcatgttgcacttgatcccgtccttctgcagcacttcggccgcgcggatgccttcccacgtcgacgcgagcttgatcaggatgcgctcgcggccgatgccggctgcttcgtacagcttgatgagctcgcggcccttgtcgatcgagcgctgggtgtcgaacgacaggcgcgcgtcgacctcggtcgacacgcggcccgggatcagcttcaggatctcggtgccgaatgcgatcagcaggcggtcgatgatgaagtcggtgctttcgttgcgatgatcgcggacggttttctcgaggatcggcttgtacgcgtccttctggacggccttcaggatcagcgaagggttcgtggtcgcgtcctgcggctggtattgcgcaagctgctggaaatcgcccgtgtcggcgacgacggtcgtgtactgcttcagctggtcgagtgcggtagtcatggcgattcggaagaagggcgcaaggcgccgggttctcacggccgcgcgagcgcggcggcgaagcgaagcggcgccgggcgccgcttccaagccatcattctaggcccgattcgcgtcgagcacgttttggcatgtccggcgagcgccgtgccgcattacgcggggcggcgcgcgttcaggatcacctgcgtgacgatccccgcgacgagccccagaaggccgagccgatcgacagcagcgtgaggcccgacgcggtgaccatgaacgtgacgagtgcggcttcgcgctgcttcacgtcctgcatcgcgttcgcgaggccgctcatgatcgagccgaacaacgcgagcgcggcgaccgacacgacgagcgctttcggcagcgccgcgaacagcgcggcgatcgtcgcgccgaagacaccggcgaccaggtagaacatgccgcaccacacggcggccgtgtaacgcttcgcgtgatcctcgtgcgcttccgggcccgtgcagatcgcggccgtgatcgccgcgaggttcacgccgtgcgagccgaacggcgcgagcagcagcgatgcgaggccggtggtcgcgatcagcggcgacgacggggtctgataaccgtccgcgcgcagcaccgcgatgcccggcacgttctgcgacgccatcgcgacgacgaacagcggaatgccgatgctgacgatcgacgcgatcgagaacgccggcatcgtgaacacgggcttcgcgaacgcgatgtgaaagccgctgaagtcgagcaggccgagaccgccggccaccgccgtgccgacgatcagcgtcgtcacgatcgcgtagcgcggcgcgagccgcttgacgatcaggtacgtgaagaacatcgcgagcacgagcgcggtctggaactgcgcggcgcggaagatctcgatgccgatctcgaacaggatgcccgcgagcagggcggcggcgatgccggccggaatcttgcgcatcagcgtgtcgaacagcccgctcacgccgacggccgtcagcagcaccgcgcagacgacgaacgcgccgatcgcctccgggtagggcacgccgggcagcgacgcgatcagcagcgcggcgccgggcgtcgaccacgcgacgacgacgggcgcgcgaaaacgcagcgacaggccgatcgtcgtcagtgccatgccgatcgacagcgcccagatccacgacgagatctgcgcatcggtgaggtgggcggcgcggccggcctggaacatcagcacgagcgagctcgtgtagccggtcatcatcgcgacgaagccggcgacgagcgcggacacggacgtatcggcaaaacggcggccgccggcgcggctggcgctcgcggtgggcgaggggttcatgctatctccggggaggccgctcggaggcgaccttcgtgtcttggtgggtgtcgttacttgctgagtgcgcgcatcgcggtttcgaggcccgcgagcgtgagcggatacatgcgatggccgagcaggtcgcggatcaccgcgaccgactgccggtattcccatagccgctcgggctccgggttcagccatgcatgatggggaactggtcggcgaggcggcgcagccacacggcgccggcttccgggttgttgtattcgaccgagccgccgggttgcagcacttcgtacgggctcatcgtcgcgtcgccgacgaagatcagcttgtagtcgggcgtgaacttgtgcagcacgtcccacgtcgcggtgcgttccgagtggcggcggcggttgttcttccacaggtggtcgtacacgcagttgtggaaatagaagaactccaggtgcttgaattcggccttcgcggccgagaacagctcttcggtgcgcttgatgtgatcgtccatcgagccgccgacgtcgagcagcatcagcaccttcacgttgttgtggcgctcgggcaccatccgcaggtcgagccagcccgcgttcgcggcggtgctgcggatcgtgccgggcaggtcgagctcctcggccgcgccttcgcgcgaagcggcgcagccgccgcagcgcgaccttgatgttgcgcgtgccgatctcgacggaatcgtcgtagtcgcggtacgcgcgcgcctcccacaccttcaccgcggtgcggttgccgttcgacgggccgccgatgcgcacgccttccgggttgtagccgccgtgcccgaacggcgacgtgccgccggtgccgatccacttgttgccgccttcgtggcgctccttctgctcgtcgagcagtgccttcaggcgctccatcagcttgtcgagcccgcccatcgcctcgatctgcgccttctcctccggcgacagctcgcgctcgaggcgcttttcgagccagtcgagcggaatgtcgaacgcttcggacggcagcgcggacacgccgtggaaatatgcgctgaatgcctggtcgaacttgtcgaagtactgctcgtccttgacgagcgtcatccgtgcgaggaagtagaacgcgtcgatcgacggcgagatcagcccggccttcagcgcttcgagcagcgtcaggtattccttcaccgagacgggcagcttggctgcgcgcagcgcgtagaagaaattgagcagcatggccgggccttcgcgggtgagggggattaccggttgtgccggttcatgtagacgagccgctcgagcaggctcaggtcctgctcgttcttgagcagcgcgcccgcgagcggcggcacgatctgcttcgcgtccgcgccgcgcagcgcgtcggccgggatgttctcggcgagcagcagcttcagccagtcgagcagctcggacgtcgacggcttcttcttcaggcccgacacaccgcgcaattcgaagaaactctcgagcgccgcgcgcagcaactcctcgcggatgtcgggaagtgcaccgcgacgatcttctgcatcgtcgacgggtcggggaactggatgtagtggaagaagcagcggcgcaggaacgcgtcgggcagctccttctcgttgttcgacgtgatgatgacgagcgggcggtgcttcgcgcggaccgtctcgcgcgtctcgtacacgtggaattccatccggtcgagctcgcgcagcaggtcgttcgggaattcgatgtcggccttgtcgatctcgtcgatcagcagcacgctcgggtgctcggcatcgaacgcctgccacagcacgcccttgacgatgtagttcgagatgtccttcacgcgctcgtcgccgagctgcgaatcgcgcagccgcgacacggcgtcgtattcgtacaggccctgctgcgccttggtggtcgacttgatgtgccactgcagcagcggcatgtcgagcgcggcggccacttcctcggcgagcatggtcttgccggtgccgggctcgcccttgatcagcagcgggcgttgcagcgtcagcgcggcattgaccgcgagcttcagatcgtcggtggcgacgtagtgcgaggacccttcgaaacgcatggcggcgctcttctcaatcgcgaaaaacccagtataagtcagaagggctgtccggttgggccgcgcccgcgtatcgttgcgggactgtggcgggggcgccttgtggacgggttcccgccgacgcggtacaatctggccgttttttggcctgcgtggcgaccgacaagcaaaacggcgcgggccgttgccgcttcggcgccagtttccctcaagctaggttacaagagctatgaacaaattcgtcggcaaacacgtcgttgtcgcagcgctcgtggcgctcgcgggcagcgcgcaggcggccggtgtggtcggcaacccgaaggacggggcgagcaaggtcgccatgtgcatcggttgccacggcatccaggactaccgcgcggcgtacccggaggtctaccgggtgcctgtcctcggcggccagaaccagcaatacctcgagaacgcgctgaaggcctaccgcaagaaggatcgtcacttccgtcgatgaatgcgatcgccggttcgctgacggaccaggacatcgcggatctgtcggcgtactacgccgcccagaaggccgactcgaaggacaacccctacaagtagcgcgcgccgccgatctctcggcgggacaggagcattcatgaacaacgcattcaagacggcggcggttgcactggcggccggcctcgcgatcggtaccgcgcacgcggcggacatcacgaagggcaaggaactggtcgaatcgcacaactgcgccgcctgccacggcgcgcagatgaacaagccgatcaacgccgaatatccgcgcctcgccggccagcatgccgactacctcgtgtgggcgatgcgccagtaccagatgggcctgacgaatccgctgctcggccgcaacaacgcgatcatgcaggcacaggtgcagagcctgtcggtcagcgacatgaaggacatcgcggcctacatcgaatcgctgaaagagaccgatctcgtgttcaagaagtaagcgcgacgggcccggcgggcccgcgcagcaaggatacccgccccggcggggtatttttgcccgcgcgccggcgcccgcgggccgccgcggcggcgctcagtcgcgcgatgcgcggcgcaggatgcgctgcaggtacgcgtcggtatcgggcggcgtgttcgtgcgctgggcttcccagatcgtctcgccgaggcattccatgatcacgtgctgcgcgtcgtgggtcgagtcgagcttcgccgcgagcttgtcgtgcgcggcgcggatgccgggcggctggtcgatcgacagctgctcgctgatcgcgagatgcatcgacaggtgcaggaacgggttcgtgcggccttcctcgggcgtgtactcgcgcgcggtggcgccatcggcgtcggcgagttcgtcgtggtattcgggatgctcgacgatccagtcggctgccatcgcttccagcggcgtcaggatctcgccggcgcgctgcttgcgccaggtttcggtgaaaagcgacgcacttcgtcgcggcttggattgaacatggtggggaaacgtcgtgattcggacggctggatgccgcgtcgcgcattgtacgccgggtcggcgggcggcgcaggcggcgggtttggcgcgatcgcgtggccgcagcggcgggggttccgcgggccttgcgggtgagcggcgcgggccggtggcgtgcgccgccggtgccgggtaacgggtaagcgtggggtaagcgcggggtaagcgcgggctaggctcgcggccgccgcgccgttacactccaacgcttcccgtcaccgcaccgttctcatccgttccgtcatgaccgccaccgctcgcccatcgtccgcagccctgcagggcacgctttacgtcgcgctatccgccgccgcgttcggcgcgatggcgatcttcggccgctacgcgtatgcggccggtgtcgacgtgctcgggctgctgatcgtgcgcttcgcgatcggcggcgcggtgctcgccgcgatcgcacggcatcgccgcgtcacgtggccgcgcgggcgcgcgctcgcgccgctcgtggcgatgggcgcgctcggctacgtcgggcagtcgttctgctacttcagcgcgttgcagcacgcgcaggcgagccttgtcgcgctgctgctgtacctgtatccggccttcgtcacgctgctggccgcgtggtggctcggcgagcacctcacgcgcgcgaaggccgtcgcgctcgtgctgtgcgtcgcgggttcggcgctgatggtcggcggcgggcatggcgagccgctcgggatcgcgctcgcgctggccgccgcggtgatctattcgctgtacatcgtcggcggcacgaaggcgacgcgcggcgtcgatccgctcgcgaccaccgcgatcatctgcctgtcggcgaccgcgacactcgtggcgatcgccgtcgtgcggaccgcggcgttcggcgcgccgccgcgctggcccgcgacggccggcggctgggcgtcgatgcttgcgatcgcactcgtgtcgacggtcgcggcgatgatcgcgttctttgcggggctcgaacggcttggggccgcgcgcacgtcgatgctgtcgacgctcgaaccggtcgtgacggtcgcgctggcggcgctgctgttcggcgaggcgctgtcgccgctgcagtgggcgggcggcgtcgcgatcctggctgccgtgctggcgctggtgcgcgcgggtggcgcggcggccgacgatgcgaccgcgacctccaacgcatagtcgggaaggggaagcggcggcgcggatggctacgcgctgtcgcggccgcggtttgccggcggagggcggccggtggggcgtgcgtcgagcgtcgggccacagggcgtccggcggcttgcggcaggccggccgcggctgtgcgtcactcgttgggcggcggggtcttcggcctgaattcgcacagcggctcgattgcgcaatgccagcattcgggcttgcgggccttgcacacgtagcgcccgtgcaggatcagccagtgatgcgcgtcctgcaggaactccttcggcgtgaacttctcgagcgcggcctcgacggcgcgcacgtccttgcccggcgcgagccccgtgcggttcgcgacgcggaagatgtgcgtgtccaccgcgatcgtcggctggccgaacgcggtgttcaacacgacgttcgcggtcttgcggccgacgcccggcaagccttccagcgcttcgcgatcggccggcacctcgccgtcgtagcggtcgagcaggatccggcacgtcgcgaccacgttcttcgccttggtccggtacaggccgatcgtcttgatgtactcggtgacgccttcttcgccgagtgcgacgatttgtcgcggggtgttcgcgaccggaaacatcttccgcatcgccttgttgaccgatacgtcggtcgcctgagcggacagcatcacggcgatcagcagctcgaacggcgtcgagtattcgagctcggtggtcggatgcggattgaggctctgcagcgtttcgtagatcgcgcgtcgtttgctggcgttcatggagcgttctggtcgggcggtgcggacgggccgtcgtcgcctgcgtcgttttcttcgtcgttgccgctcgcggccgccgcttcggcgtcgcgttgggcctgctgttccgcgagccgcttgcggcgcgcctcggcggcgtcgatctgtgcctggactgccgcgctcacgccctcggtgttcttcggcccggcaccttgcccggacagttcttccttcttcttgcgcgcacgctcgagcgcggcggcgatgatcgcgcgcttcttcgcttcggcgtcatccgcggccggtgcggcggatggcgttcccgcggaggccgcggccggcttcgcggcgctggccgcgcggcgtgcggccgcgcgcgcttcggcggcttcgcgttcgcggcgctggcgcgcgagccgcaggtcgtggcgttcgcgcgcggcatcggcctgttcctgcgaccacgcgtcccagccggtgcgttcgccggtcaccggcagcattgcgatgcagtcgaccgggcagggcggcacgcacaggtcgcaacccgtgcacagcgactcgacgatcgtatgcatttgcttcggcgcaccgacgatcgcgtcgaccgggcacgcctgcatgcacagcgtgcagccgatgcacaggctttcgtcgatgaaggcgacggcgcgcggatgctcgctgccgttcacggggttcagcggaatcacgggcttgccgagcaggcccgcgaggcgcgcgatgccttcggcgccgccgggcgggcactggttgtagttcgcgtcgccggcggcgatcgcctcggcgtacggccggcagccgttatagccgcacttcgtgcattgcgtctggggaagcagatcttcgatgcgatccgcgagtgttttggagtcggtcacggtgacaacgggcgcagcggcgccgaatggctctcggccgcttcgggcgcggccggaaaggtttgccaaagctcgattatcgccgatttcccgcattgcgctggacgccgtctgtgcgcataatcgaaccgctttttgcaggggctcagcaggagggcggccgcccgcggcgcgcccgttccagggcggccggcgccgaggcggtggggtgccggtccggatcaagcggctcacatagcaaaacgccaccatgaatcagccaaaaatcaaaagagatcctgaaggtacgcgccgccgcatcctgatggcggcagccgaagagttcgcgagtggagggctgttcggcgcgcgcgtcgaccagatcgcgcgccgggccgaaaccaacgagcgcatgctctattactacttcggcagcaaggagcaactgttcacggccgtgctcgaacacgcgttctccgcgctgaccgaggccgagcgcgtgctcgacctcgacggcgtcgcgccggtggaagctgtcacgcggctcgcgcatttcgtctgggactactaccgcgaccatccggaactgctcaggctcatcaacaacgagaacctgcacgaagcgcgctacctgcacaagtcgacgcggatccgcgagatgatgtcgccgatcgtcgcgaagctcggcaacgtgctgacgcgcggccagaaggctgggctgttccgcaccgacgtcgatccgctgcgcttctatgtgacgctgtcggggctcggctactacatcgtgtcgaaccgcttcacgctcgccgcgacgctcggccgcgatttcaccgacaccgacgaacgcgccgagatggtccggatgaacaccgagttgctgctcgcgtatctgctgcgtcgctgacgcaccggctggccgaagcggtcgaaggatgcaaaaacgccgccgtgcgcaggcaacggcggcgtttttcgtcggaacgcggtgcgtcaggcggccttgcgcgtacgcacggccttgacgcgcgggccgccggcggcgcgtttcgcggccggtgcggccttggccggcgccgctgcgactgccttggcgggggccttcgcgcgcgtgcgcttcgccgcggtggcgcgcgtcgtttcgagcggcgcatggctggccggcacggcggagagcgtcttgggcgccggcgcatccgcggcatccttcgtcgcgccgtgcttcggctccggcgcatgctcgcggatgaagtcgcgcagttgcggatagatgatcgtgcgccagcggcggcccgagaaaatcccgtagtgaccgcacttctcggcggtcaggctgcgacgctggtcctgcgggatgcccgtgcacagctcatgcgcgacgtgcgtctggccgctgccggagatgtcgtcgagttcgccttcgatcgtcatcagcgcggtacgcttgatgtcctgcggacgcacgcgctcgccttcgacatcccacgtgccctcggccagccggaattcctggaacacgatgcggatcgtctcgaggtaatactcggcggccatgtcgagcaccgcgttgtattcgtcatagaactggcggtgcgcttcggcgtcttcctcgtcgccgcgcagcaggctctggtagaaatcccagtgcgactgtgcgtgccgctccgggttcatcgcgacgaaacccgtgtgctgaaggaagcccggatacacctggcggccttcgcccgggtagttcgcgggcaccgtgtggatcacgttgttctcgaaccacgcggtcgagtgctgcgtggcgagcgaattcaccgacgtcgggctgcggcgcgcatcgatcgggccgcccatcatcgtcatcgtgagcggcgtgtcctcgccgcggctcgccatcagcgagatcgccgcgagcaccggcaccgtcggctggcacaccgagatcacgtgcaggttgcgcgcgccgatgtgacggatgaattcctggatatacgcgatgtagtcgtgcaggtggaacgggccgacctcgaccggcaccatccgcgcgtcgatccagtcggtgatgtacaccttgtgatcctgcagcagcgtgcgcacggtgtcgcgcagcagcgtcgagtggtggcccgacagcggcgcgcagaccagcacgaccggctcgtccttcaactgcgtgacggcgtcggcgtcgtccgaatagcgcttgaagcgcagcagccggcagaacggcttctcgacgatcgtctgctcgacgatcgggatgttgtggccgtccttgacgatctggtgaatgttgaactcgggcttctcgtaatccttgccgagccggtacatcagctcgtacgcggcggccatccgcggcgcgccgggcatcagcgagaacgggctggacggattggcgaacgatttggacgcggcctgggcccaggccgtcagcgggctcagcatggctcgctggaattcgtgcagttggtaaagcatgcagactactcccgcgtggggacggtgcgcaagggcggcgtgaggcgtcgcggcgtgccgtgtgggtcagcggccggccatgttgcactgcagccggacaatcgcgtcgatcatatcggacaacgatgggtggtgcaatgcaacatttcccgatttttcatcaaagttttgcgatttgacgttctctgaacaagccgctcgcgccccgttcagcgccccgtggcgacggccggcgccggctggccggccgcgcgcgccatcgcgtcctcgtggtgcatcaggttcatcgcggtatgcacgagcgccacgtgcgagaacgcctgcgggaaattgccgacgagccgcccggccaccgggtcgtattcctcggcgagcagcccgaggtcgttcgacagcgcgagcagccggctgaacaggcggtgcgcgtcgtcgatccggcccagcagcgcatagttgtcgaccagccagaaactgcacgcgagaaacgtgccttcgccgggcggcaggccgtcgtcgtattcggtcgtgcggtagcgcatcacgagcccgtcgtgcagcaactcccgctcgatcgcttcgaccgtgccgacgatgcgcggatcttccggcggcaggaagccgagcagcggcatcagcagcacgctcgcgtcgagttcgtcgctgccgtagctctgtgcaaacgcccgtttgctttcgtgccatgcgttgttgcacacgtcggcatggatctgctcgcgcagcgcgcgccagcggtcgagcgagccgggcagccggaacatctccgccgacttgatcgcgcggtcgaacgcgacccacgccatcaccttcgagaacgtgaaatggcggcggccgccgcgcgtttcccagatgccttcgtcgggctcctgccagatcttctcgagatggtcgagcagcgcgcactgcaccgaccacaccgtgtcgtcggcctgcaggccgcccacgcgcgcgaggtgcagcgcggccatcacctcgccgaacacgtcgagctggagctggttcgcggcgccgttgcccacgcgcaccggcttcgagtcctggtagccgggcagccagtcgagttccatttccggcagccggcgttcgccggcgattccgtacatgatctggatctgttcgggcgagccggccatcacgcggccgagccacgtgcgccacgcgcgcgcctcgtcgtagtagccgccgcgcatcagcgcgagcagcgtgatcgtcgcgtcgcgcagccagcagtagcggtagtcccagttgcgattgccgccgatcttctcgggcagcgacgtggtcggcgccgcgacgatcccgccggtcggctcgtacgccagcgccttcagcgtgatcagcgaacggcgcacggcggccgcgtagcggccctgcacctggcagcggcccgaccattcgagccagtagttctcggtgcgtgcgagcatcgacagcggatcgcgtgcgggcggcagccgcatgtgggacgccgcatagctgagcgagaacggcacacgttcatcggcgttcacggtgaattccgcgagcgtatggaggttcttgccggtgagcggcaccggcgtgcgcagcacgacggtgtcagggcccgcgatcgccttcatgccgtcctcgcgggtcagctgcgtgacccacggaatcgagaaaccgtagtcgaagcgcagcacgagctccatgcgcatcttcatcgtgccgtggcggccgatgacgatccgcaccagctcggaccagccgttgccgggcggcatgaagtcgaccaccgtgacggcaccgtcggcgctttcgtagtcggtttcgagaatcagcgtgtcgccgcgatagcggcgcgacgtgtgcgtgatcgcggcatcggcggccggcgcgagcagccagcggccgtgctcggggtgccgagaagcgccgcgaagcaggcgcccgaatcgaagcggggccagcacagccagtctacggagccgtctttggcgaccagcgcggcggtgtggccgtcgccgacgagggcgtagtcttcgatcagggcaggcatgggcaggcgatccttgggtattcgagttcacaatgcggacggcggcggccaaggcttcacgcgcgggcgccgcgccccgtatactcggccgggcggcggagcgcatgaacggccggcgtttcgtcctatctcaacacttgaagcgactcgatgcaaggaggattcaatgcccaaccgtttacgcgagcgtgacgcacgcgcttcgacacgagggttcccgcttaggctcgctcactggatgaaaggtttcgcgatcgtgctctccctttccgcgacccatgcatttgcgcagcaatcgcccgctccggccgacggcgtgtacaacctgctcgtcggcacctacacgggcggcggcagcgacgggatctatgtttaccgcttcgatacgaaaaccggcagcgtcgcgccggtgtcgtcggcgaagacggtgaatccgtcgtacctgttgccgagccgcgacggtcgtaccgtctacgcggtcaacgaactgcccggcgacgacgggccggcgtcgcagcgcggcggcgtcagcgccttccgcttcgacgcgaagacgggcgcgctgagcttcatcgaccgcgtgtcgtcggaagggaacgatccttgctatctcgcgctgtcgccggacggcaagtacctcgtgacggccaattattcggtcgcgaaggatccgggcggcagcttcgcggtgtttccgctgcgcgacgacggcgcggtcggccaggccgtgctgacggtgcaccacgagggcacggggcccgtgaagggccgtcaggacggcgcgcacgtgcattcgacggtgttttcgccggatggccattacctgttcgtgcaggatctcggcgcggacaaggtctacggctaccggtacacggtggacggcagccgcgggctgatcagcccgaccgacacgcgctacacgccggtcaaggcgggttcgggcccgcgtcacatggtgttcagcgccgacggccggtacgcgtacgtgacgagcgagctcaacgcggcggtcgaggtgttcggctaccacgacggcaagctgacgccggtcgagaccgtatcgatgaccgcgccgggcttcaagggcaaggtcggcggcggtgcgatccatctgtcgcctgacggccgcttcctctacgtgagcaaccgcggcgatgcgaacgacctggtgatctacgcggtgaaccaggccgacggccggttgaagcccgtcggccgccagtcgagcctcggcaagacgccgcgcgagttcctgatcgacccgaccggcaagtggctgatcgtcggcaaccaggacagcgatacgttctacgtgttcagccgcaatgtggaaacggggcaactgggcccgaatccgcagaaggtggcggtcggcaagccggtcgatttcaagctggtgccggtgcagtaaatgacaaagggcgctgccgatgcagcgccctttgcttttcggggcggccggtttcccggtggcccgcatcggtggacggcggcggcggccgcgctcagtcggccgcggccggcacgagcacctcgcggctgccgttgatgcccatcggcgacaccagcccggccgcctccatctgctcgacgaggcgtgcggcgcggttgtagccgatgcgcaactgccgctgcaccgacgagatcgacgcgcgccgcgtgcgcacgacgaacgcgacggcttcgtcgtacagcggatcggcttccgcgtccggcgcatcgccgaacaggtcctgcgtcgcgccgtcggcggccgggccgtcgaggatcccttcctcgtactgcggttcgccgaactgtttcaggtactcgacgatccggtgcacttcctcgtcggcgacgaatgcgccgtgcacgcgctgcggataaccggtgcccggcggcaggaacagcatgtcgcccatcccgagcagcgattcggcgcccatctggtcgagaatcgtgcgcgagtcgatcttcgacgacacctggaacgcgacgcgcgtcgggatgttcgccttgatcaggcccgtgatcacgtcgacggacgggcgctgcgtcgcgaggatcaggtggatgccggccgcgcgcgccttctgtgcgagacgggcgatcagttcctcgatcttcttgccggccaccatcatcaggtcggccagctcgtcgatcacgacgacgatcagcggcagcgtcgacagcggctcggggtcctcgggcgtcagcgagaacgggttgccgatcttcttttccttcgcttcggcatcgcggatcttctggttgaagcccgcgaggttgcgcacgccgacggccgacatcagccggtagcgcttctccatctcgccgacgcaccagttcagcgcgttggccgcgagcttcatgtcggtgacgaccggcgcgagcaggtgcgggatgccttcgtagaccgacagctccagcatcttcgggtcgatcatgatgagccgcacgtcctcgggagtcgccttgtacagcagcgacaggatcatcgcgttgatcgcgaccgacttgcccgagcccgtcgtgcccgcgacgagcatgtgcggcgccttcgcgagatcggtgacgaccggatggccggtgatgtccttgcccatcgcgatcgtcagttgcgaggccgagtgctggtactggcgcgactcgaggatttcagacaggcggatcatctggcgcttcgcattcggcagttcgagacccatgcaggtcttgccgggaatcgtctcgacgacgcggatcgacgtgaggccgaggccgcgcgacaggtccttcatcagcccgacgatctggctgccccgcacgccgagcgcgggttcgatctcgaagcgcgtgatcacggggccggccgatgcgccgactactgttaccggcaccttgaattcctgcagccgctgttcgatgacctgcgcggtttgcgcgaggtgttcgtcggtgatcgtttcgatgtcgtcggacgcgggttcgagcaggtcgagggtcggcagttcgacgttgaacgtcgcgggcgcgtggaattcgaacgcgttcgggcgcggcgggcgggcgggggtgtcgggggccggtgcggcgggttcggttgttgccgcggcggcggtcgcttctgccggcagggcagcgggaatcgccggtacgggcgtgaccgccgccggtgcggacaggctcgcgccggggaatgtcgtggcgggttgcggggcagcggctgccggtgtcgcggtgacgttcggcacgtgccagcttgccggcgacgaggccggggccggggcgggcggggctgcgaacgtcgtggcttcgatcgcggcaggtgcggaagcgatcgacggagtcggtgtcgcggcggttgccccgaaggacggcagcgagccggtcggagcgacgggcgagccggagatcggttgcgccggagtcgctgcggcggacgtgatcggtgcgacggcgccggggacggtgcagtcgtgtcggaaacggccggcggcacgggcaggcttgcggccggctgcggtgtgaccgcgccggaggtgccgaacgtgccgaatgtcgtacccgtcgatgagcttgccgggttggccggcgccggcgcgggcgagccggacgcggtgttcacgggtatcgcggcgacagccggtgcgggcgccgtcgaaccggatgtcgaagccgacgtgccggccgtcgacggagtcacgacgggcgatgtgggcatcgatgcacggggaacgaaccgtaagtcgtgcccgtttcgttgaccggggctgtcgacgcaaccgatgcaacggtcgatgtcgacgcggccggctgcgaaggcgaagccgacgcagtaccggctacgccgaccgggggtgtcgatggggcggatgcaggtgtcggtgccgatgcggccggctgcgaaagcgaagccgacgcagtaccggttacgccgaccggggatgtcgatggggcggatgtagcggtcgatgccaatgcggacggctgcggcagtgaagccgacgcagtaccggttacaccgattgaggatgctgttgcacccgatgcagcggtcgatgccgaggcggccggctgcgaaagcggagccgacgcagtaccggttacgctgaccggggatgtcgatggggcggatgcagcgttcgatcccaatgcggtcggctgcggcagtgaagctgacgcagcaccggtttcgccgaccagggatgccgatggggcggacgcaacgttcgatgccgatgcggccggctgcgaaagcgaagccaacgcagcgccggttgcgccgattgcggatgtcgacgcgactgatgcagcggtcgatgccgacgcaggcgactgagcagacgaaccggatgtcgtgccggtcacgcgatccatcgaagcggaatcggcgacaggcgatgtccccgaagcgaatgcaggtgcttgcgcggccaagccttgagcggtgccgacgagcggcgacgcagcagccgaagccgtctgcgttgcggcggcaaacggttgagcggcgaccggcgatttcggcaattccacggcgacggtcgcactcgtcggggcagattgcgccgtcgacggtttccaagtccattccgctgccggcatggagccctgagcgcttgccgacggcggtgccgtaggttctgctgcgtccgccttgacggcttccggtgctgcacccgacgcggccgatcccgacgttgccgacaccgccgcaaacggccaggcttcggcacttgcgcgtgacgtcgtttcggtgatcggcgaagagggagggcagcgaacggagcgatgttcccggccgttttcacgtcggcgtgcgcatcgtcgatgccctgcggtacgcgggccgatgcgatgtgatcgattgcggcagccggttgcgccgtgtacctgtcgtcgttatcgacgggcgccggcaggttgctcgcggcgatgtcgcgagccgcctcgcgcctgggttgcgcggcggcagcatcggccggttccgattccgtcgcgtccgtcgacgactcggcggccgggttccacgcggatgcgtcgaacgcggaaaccggccggctggcgaggtcttcccacggtgcgaggtcgatgggcgcgtcgaacgaaggtgagggtgcggacgggattcccggcgtcggcgcggcaggcgcatcgtcggcgtaccggatctcgtcgtcggcgtgatgcgaaaacgcggcatcgtcgctgccggtatttggcagcgcgtgcggggcggccgcgtcgagcgccacggtgcccgcatcggcacccggtgcatgaacagcgggcgccgccggcatgaacgcgtcgagcacgatcggtgcgttgtcgtcgtacgccggcgccgcatcgtgcgcgagcgacacagcggcgtcatgcgcggcgaggccgtgggtcgcggcggcgatcccggccggcacggccggcatggtcgatgcggccgccgatgccggcgccgcaacgccggctgctgccacggccacaccggccacggtagcggctgcggcggcagcgtgcccggcgtcggccggctgcgcaccgcccagcgtcgcccattgcgcggtgctggcctcgatcgagcgcagcgtgtcgtgcacgctcggtgccggcgcgatcggcgcggcgggtttttccgtccatgcatagagcggcgcacgcgccggtgtttgcggcgccggacgacgtcgtgccgtatccgcaggctgaccggccgaacctgcgccagtgacggggcgtaccggcgggcgctgcggctgtgcggcggccggccgcggcgtgaccgtggtacgcggcgtagccggcttcaatgcggccgtggccggtcgcgcggctgtcgggcgcgggcggacgggttcgaatccgacgggaagcggggctggatcggggcgcgagacctgcgaattcgccgctgcgcgcgccaggctagcggtgctgccggtcgtcggcggcggcatcgcgctggccggggatcggtgcgggctgcgtcggcgcgcgctggggcgcggtcggcttcaaccagcccgacggcgcgacgggttccacgtgggggcgcggggcgctgctgcgcggcttcggccgcacctgcggatcgggtttccacagcgtcggacgcgaataccggccgttctggcgcggcgccatcgaattgacggtatgcgcggtggtcggctgtacgacgtcgtcgtcgcgatgcagcgcgctgcgcggcaggtcggcaatgccgcgggcgtcgtcgtcgccgccgtcgcgcgacagcttgacgccgaacgacgtgtcaacccacgcggcgaactgtcgccagccgatgccggtcaaccagggcagcccggcgaagaacagcacgaccatcgcgaccggcgtgccgatcgggccgagcacgtgggcgaagcctgccgagaacgcatggccgagcgcgttcgtgtcggggcccgacagcgggctcgtcagcgtgcagctggccacgaacaccgcggcgaagccgagccacagacggatcgagccgcggccggcgagcccgccgccgccgggcagcatcgcctgcacgagacgccagaagagaaggaggaaccagacggcggagatgccgaaccagccgaagacaaccgtgtgcatgctttgaaacaggagtggggaggggcgcgcggggcgcgacccgccgagtttaaccggccggcgaacaagactctaacgcggcgtgcatccgcttcacgccgcgcacgtgggtgcgcggcacacgcgcgtggcgcgccacgcgaaggcggtcggtcggccttcgcgcgcgcggtgctgcatcaggggctccggtgcgtgaaggtcagcgttgcgccggacgcggtcacgatctgcaattgctgcggctcgcgcatctgcacgccggtcttgtcgatgtgggcgagtgcgtcgaggtacgcgggttcgagctggccgccgagcgtattcgggcaggccatccgcgtgccggcgagcggcccgaagctcaacaggccgttcttgatcgcgtaggtgcccatgtagcggttgcagcccgagaacccgctcgcgcgccggatgcccgactcggtcgacagcgcgagcttgatcggctcgccgttgtcgccgtgcgggatcgcgcgctgcgtgccgtcggcgttcagccagctggtgagctcccagctcgtgtcgtcgagcagttggacggcggccgggttgtacgggtcgggcgcgggggcggcggaatcggggtgggtcggcatcgcgcaggcggcgagaagcgtggcaagcgtcaacgcgcagagcggcgcgcgcaacgggcgaagcaggccggtgcgtgcgcgtgcggccgcggacaggtgggacatgagcctcgttcctcatcggattctgatcaaggcgtaagagtaacgcacccgccctgcggcaggcgagccgacacttcgcgcgtgaaaacgttcgcagcccgctcgcgagcggcccgaggcggggcggcggcacggcgaaacgcgccaaaccggtgtcgtggcgcgtgttaacatcggagccgttttcgtcctccaccagaagcgggtaatcacatgcagatcggtcagcggctcggtacgccgctctcatcctcggccacgcgcgtcatgctgctcggcgccggcgagctcggcaaggaagtcatcatcgcgttgcagcgtcttggtgtcgaagtcatcgcggtcgaccgctatccggacgcacccggccatcaggtcgcgcatcgcgcgcacgtgatcgacatgaccgacgccgccgcgctgtgcgcgatcgtcgaggccgaacgcccgcacctgatcgtgcccgagatcgaggcgatcgcgaccgacgcgctcgcggcgatcgaggcggccggtctcgccgaggtgatcccgaccgcgcgcgcgacgcagctcacgatgaaccgcgaagggatccgccggctcgcggccgaggagctcggcctgccgacgtccccgtatgcgttcgcggattcgttcgaagcgttcagcgcggccgtcgcgaagatcggcatgccgtgcgtcgtgaaacccgtgatgtcgtcgtcgggcaaggggcagtcggtcgtgaagaccgaagccgacgtgaagccggcgtgggactacgcgatggcgggcgggcgcgtgaaccacggccgcgtgatcgtcgagggcttcatcgatttcgactacgagatcacgcagctcaccgtgcgcgcgatcgatccggcgacggacgccacgcgcacctatttctgcgagccggtcggccacgtgcaggtggcgggcgactacgtcgagtcgtggcagccgcagccgatgagcgcggcggcgctcgagaagtcgcgcgaaatcgcgcacaaggtcaccgaggcgctcggcgggcgcgggctgttcggcgtcgagctgttcgtgcgcggcgacgacgtgtggttctccgaggtgagcccgcggccgcacgatacgggcctcgtcacgctcgcgtcgcagcgccagtcggagttcgagctgcacgcgcgtgcgattctcgggctgccggtcgatccggcgctcggttcgccggccgcgtcggccgtgatctacggcgggctcgacgagcgcggcatcgcgttcgaaggcgtgcgcgacgcgcttgcggtgccgggcgccgacctgcgcctgttcggcaagccggaaagttttgcgaagcggcgcatgggcgtcgcgctggccaccggcgcgaccgtcgacgaagcccgcgaacgcgcgaagcgtgccgccgcggccgtccggcccgtgtcggcgcgctgacgtaaccaggagaggacgatgacgccaaggtggctgcgtatcggaaagctgggcgccgcactggcgctggtcgcgagtctcgcgggttgcggcgtcgcggccgcaccgtgccgggtggcttcggccgggctcaagatcgtgccgctcgtcggccatctcgcggccgcgccgaccgacgcgtgtgccgacgtcatcgatccctgatcacgctatacgacgcgatcgccaacaataattgcgcgccccgcgagggcgcgtttccacccgtctcgtgagaggacctgcatgattcgccaaacgctcgccgcgctcgcgctcgccggcaccgccgtttccgtcgcgcatgccgcgcaactgaccgtcgaagagatcgacgccgattcgcgccagttcgccgtctaccagtgcgcgaaccagaaacagcccgtgcgcgtgtcgtactggctcgcgggcaacggccagagcttcgcgctcgtgccggtcaacgggaagcagatgctgttcgtcgacaccgtgtcggcgtccggcgcgcgctaccaggccggccgctatacgtggtggacgaagggcaaggaagcgacgctgcgcgacgagatcgccgaccagaacgcgccgccgctgctgggcgactgcgtccaggtcgagaagaaaaagaagaagggctgagcgacgggcgggaacgtggatcgtgcctggcggtggcagccggcggcaggctccatggtgtgactgtctggcgcgcgggccggcggcgggcgagccggtgaggcgatccggcaaggcgatccggcaaggcgatccggaatctgacccctgaaattatccgtcgaccgatcgggatagcccgataggggcattcgtcgaccgcgcggccctgcccgggcccgtcgcgcgtaccgccgttggggccgttcgcggcgttgtcacggacagatggctgcgcagtgctacaatacgcccctttccgccggcattcgcgccgaacggagtccgcacggcctggcgtccagcgttcgcattgaaccggtcccaagcgccagagcggcgccgcgcggcgcgccgcggctccgtctatttccgaattgtgatgagcgcaggcccggctggcctgacgcacgatgtccccgccgcgccttttgagcgaaacgccaccatgtccgattctgtcgccaagcccgtcgacgcaaccttcgatcaattcggccttgccgccgatatcctgaaagccattgcggagcagggctatacgacgccgacgccgatccaggcgcaggccattccggtcgtgctcgccggccgcgacgtcatgggcgccgcgcaaacgggcaccggcaagaccgcgagcttctcgctgccgatcatccagcggctgctgccgcaggccaacacgagcgcgtcaccggcgcgccacccggtgcgcgcgctgatcctcacgccgacccgcgaactcgccgaccaggtcgccgcgaacgtgcacgcgtatgcgaagcacacgccgctgcgcagcgcggtcgtgttcggcggcgtcgacatgaacccgcagatggccgaactgcgccgcggcgtcgagatcctgatcgcgacgccgggccgcctgctcgaccacgtgcagcaaaagacggcgaatctcggccaggtgcagatcctcgtgctcgacgaagccgaccggatgctcgacatgggcttcctgcccgatctgcagcgcatcctgaacctgctgccgaaggaacgtcagacgctgctgttctcggccactttctcgccggaaatcaagaagctcgcgtcgacctacctgcgcaacccgcagacgatcgaagtcgcgcgcagcaactcgacgaacgcgaacgtcacgcagatcgtctacgacgtcgccgaaggcgacaagcaggcggccgtcgtgcagctgttgcgcgatcgcgggctcaagcaggtgatcgtgttctgcaacagcaagatcggcgcaagccggctggcgcgcaatctcgagcgcgacggcgtggtcgcgtcggcgatccacggcgacaagacgcagatcgagcggatgcaggcgctcgacgcgttcaagcgcggcgagatcgaggcgctggtcgcgaccgacgtggccgcgcgcggcctcgacatcgccgaactgcccgccgtgatcaacttcgacctgccgttcagcgcggaagactacgtgcaccggatcggccgtaccggccgtgcgggtgcgacgggcgacgcgctgtcgctgtgcagcccgaacgagcgcaagcagctcgccgatatcgagaagctgatcaagcgtccgctcgaaatgcagacgctcacgctcgacaagccggcgcgccatcgtcacgacgagcgcggcaacgaccgcggcggcgatcgcaacagcgagcgcggcggcgaacggggcggccgtcgcgaacgcgacgaacatcgcggtgcgtcgggacgccgcccgggcagctccgagcgcggtcatcaccgtcgccacgaagcgccggtcgacgatttcttcctgaagccgtacgagccgtcggcgcccgcgaagcagcgggacgacgcgcagcctgcgcagcagcccgagaagaaggggccgaagcgtcaggtcgccgcgctgctcggcgggttcgggatgccgcgcaagccgtcggcgtaagcctggcggacgcgacggcgcggcgcgcgagcgctgcgggaaaagcgggtgcatgcgatgagcatgtgcccgtttttcattgggggcgcggttcgatggtggagcggaagaaggcgcttggcgccggcggagagcgatgcaagcggcacccggcggacgcgcgatcggcgcgaaaccgcgcgtcagccggcctgcggcccgaagcgcgtcgcccacgcggccgttgcggctgcgtagaacgcatcgagagtcgtgcctgcgagcgcgccggccggcgcgaggcccagatgcgcggccgcagcctgcagtgccggcagcggatcgtcgcgttcgagcgcggtcgcgcccgtctgcttgctgagcttttcgccgttcgcgtcgaccaccacgggcacgtgcaggtatcgcggggtcggcacgccgaggcagtgctgcaggtagatctggcgcgcggtcgagtcgagcaggtcggcgccgcgcacgacgtgcgtgatgcctgcatcggcatcgtcgacgacgaccgcgagctgatacgcccattgcccgtccgcgcgtttcagcacgaaatcgccgacttcggtcgcgaggttctgcgtttgcgcgtgctgccagcgatcgtcgaacgtgacgatcgcggcggcgccgtccggcacgcgcagccgccacgcgcgcgcgggcttgccgtgcaggccggtgcggcaggtgcccggataggcgagcgtcgtgtggcgctcgtgcgcggcgcgcagcgagtcggcgatttccttgcgcgtgcagccgcacggatagacgagcccggccgagacgagccgttcgagcgcggccgtataggctgcgtcgcgggtgctttgccagacgggcggctcgtcgggcgtcatgccgaaatgcgcgagcgtcgcgaggatgtcgtcggccgcaccgggtaccgtgcgcgggccgtcgagatcctcgatgcgcacgagccatgcgccgccgtgtgcgcgcgcgtcgagccagctcgcgagcgcgccgaccagcgagccgaagtgcagcgggccggtgggcgacggcgcgaagcggccgcgataggcgctcatcggggcgcggggcggcgcgcggtcaggctgcgctggctgccggtgcgcaggccgggcacgactggccgggcacgtagctcggcgactgttgtgcttccggcgtgacgaccgcgcggcacgcgaagcacgtgacgttctcggtgggctggagttgcggattcagcgcggtgcggtagtcgaacacgaagcagtcgccgtgatagtgcgcgccgccgacttcctcgaagtatttcaggatcccgccttcgagctggtacacgttctcgatgccgatgtccttcatgtggatcgcggccttctcgcagcggatgccgcccgtgcagaacgacacgaccgtcttgccttcgaggtcggcgcggttcgcgtcgatcacttccgggaattcgctgaacttgtcgatccggtagtcgagtgcgttgtcgaacgtgccgacgtcgacttcgaatgcattgcgcgtgtcgagcatcacgaccgggcggcccgtgtcgtcgtggccgcggtcgagccacgtcttcagcgtgcgcgcgtcgacgaacggcgcgcggccgagttccggcttgatcgccggtttcttcatcgtgatgatctcgcgcttcaggcgcacgagcatccggcggaacggctgcgaatcggacaggctttccttgaactgcagcgacgcgaacttgccctcgaacagcggatcgtgacggatgtacgcgatgaatgcgtcggcggcgtcacgcgtgccggcgatgaacaggttgatgccttccggcgcgagcaggatcgtgccgcgcaggccgagttcgttgcagcgggcggtgacgagcgggcgccattgctcggtcgcgtcgagcgacacgaagtggtaggcggcgaggttgacgatggtcatgatggtccgacgggaaaacggccgcacggcggcccgcaaaaagggtgcgaagccggggcgttgattcgaaaaaccgtattatcccgcaaacggcgcgggcatcggtacctggccgatcggccaaccgcgcgacgcgtcgccgcgcgcatcggccgaacggccaaagcgggcatttttgggcagcctgcgcggcggggcggctacaatagcgcccatgtcagatccccgcttcgtccatcttcgcgttcactccgaattctcgattgccgacggcatcgtgcgcattgacgacatcgtcaaggcggcggccgcggacggtcagggcgcgctcgcgctcaccgatctcggcaacgcattcggtctcgtccgtttctaccaggaagcccgcggcaagggcatcaagccgatcgccggctgcgacgtctggatcgccaatcccgacgaccgcgacaagccgtcgcggctgctgctgcttgtcaaggacaaggtcggctacctgaatctctgcgagctgctgtcgaaggcgtggctcacgaaccagtaccgcggtcgtgcggaactcgacgcgagctggctcgacggcgagctcgcgcaggggctcctcgcgctgtcgggcgcgcaacagggcgatatcgggctcgcgtttgccgcgggcaacgaagaagccgcgcgccgtcacgccgagcgctgggcgaaggtgttcccgggcggcttctacatcgagctgcagcgttacggccagccgggcgccgaggcgtacatccagcaggccgcgacgctcgccgcggcgctgaagctgccggtcgtcgcgacgcacccgacgcagttcatgaccgacgacgatttcaccgcgcacgaagcgcgcgtgtgtatctcggaaggcgacatcctcgcgaatccgcggcgccagaagcgtttcacgaccgaccagtatttccgcacgcaggacgacatggccgcgctgttcgccgacctgccgtcggcgatcgcgaacacggtcgagatcgcgaagcgctgcaacctgaagctcgagctcggcaagccgaagctgccgctgttcccgacgccggacggcatgtcgctcgacgactacctcgtccagctgtcgaaggaagggctcgagacgcgtctcgcgcagctgtatccggccgaagccgaacgcgacgcgcagcgcgacacgtactacaagcgcctcgaattcgaatgcgggaccatcacgaagatgggctttcccggctacttcctgatcgtcgcggacttcatcaactgggcgaagaacaacggcgtgccggtcggcccgggccgcggctcgggcgccggttcgctggtcgcgtacgcgctcggcattaccgatctcgacccgctgcgctacaacctgctgttcgagcgtttcctgaacccggaacgcgtgtcgatgcccgacttcgacatcgacttctgccagcacggccgcgatcgcgtgatccagtacgtgaaggaaaaatacggcgcggacgccgtgtcgcagatcgccaccttcggcacgatggccgcgaaggcggccgtgcgcgacatcggccgcgtgctcgacctcggctacatgttcaccgacggcatcgcgaagctgatcccgttcaagccgggcaagcacgtgacgatcgtcgacgcgatgaaggaggagccgcagcttcaggagcgctacgaccacgaggacgaagtgcaccagctgctcgacctcgcgcagcgcgtcgagggcctcacgcgtaacgtcgggatgcacgcgggcggcgtgctgatcgcgcccggcaagctgaccgatttctgcccgctgtacacgcagggcgacgacggcggcgtggtcagccagtacgacaaggacgacgtcgaagccgtcggcctcgtgaagttcgactttctgggtctcacgacgctgacgatcctcgactgggccgagcgctacatccgccgcctcgatccgtcgaagtccgactggtcgctcgcgcaggtgccgctcgacgatcccgcctcgttccagatcctgaagaaggccaacacggtcgccgtgttccagctggaaagccgcgggatgcagggcatgctgaaggatgcgcagcccgaccgcttcgaggacatcatcgcgctcgtgtcgttgtaccgtccgggcccgatggacctgatcccgagcttctgcgcacggaagcacggccgcgagaaggtcgactatccggatccgcgcgtcgaacccgtcctgaaagagacctacggcatcatggtctatcaggagcaggtgatgcagatggcgcagatcatcggcggctactcgctcggcggcgcggacttgctgcgtcgcgcgatgggcaagaagaagcccgaggagatggccaagcatcgcgagatcttcgccgagggtgcggcgaagaacggtctcacgcgcgagaagtccgacgagatcttcgacttgatggagaagttcgcgggctacggcttcaacaagtcgcacgcggctgcctacgcactgctcgcgtatcacaccgcgtggctgaaggcgcaccatccggccgaattcatggcggccaacatgacgctcgcgatggacgacaccgacaaggtgaagatcctgttcgacgattgcatcgtgaacaacctcgccgtgctgccgcccgacatcaaccagtcgcattaccgcttcgagccggtcgcggaagccgacggcaagcgctcgcgcacgatccgctacggcctcggcgccgtgaagggcagtggccagaacgcgatcgaggaaatcctgcgcgcccgcgaggaaaagccattcaccgacctgttcgacttctgcgagcggatcgaccggcgcgtcgtcaaccgccgcacggtcgaggcgctgatccgcgccggcgcattcgattcgctgaacacgaaccgcgcccagctgatcgcgtcggtgccgctggcgatggaagcggccgaccaggccgaggcgaacgcgatgcaggccggcctgttcgacatgggcgccgaatcgccgcacgcgcatgcgctcgtcgacgagcccgcgtgggacgacaagcgccgcctgcaggaagaaaagggcgcgctcggcttctacctgtccggccacctgttcgacgcgtatcgcgacgaggtgcgccgtttcgtgcggcagaaggtcggcgacctgaaggaagggcgcgacaagctcgtggccggcatcatcgcttcgctgcgcacgcagatgacccagcgcggcaagatgctgatcgcgctgctcgacgacggctcgggccagtgcgagatcacgatcttcaacgagcagttcgaggcgaacaaggcgctgttcaaggaagacgaactgctgatcgtgcaggggcaggcgcgcaacgatgcgttcacgggcggcatccgcttcacggccgacacggtgatggatctcgaacgcgcgcgcagccgttatgcgcaggccgtgcggctgacgatgaacggcaacgccgacgcggccgcgctgcgctgcgtgctcgagccgcacgtgtcgaaggacgatcccgcggccacggctgcggtcgaggcgcctgcaccgcgcggcggcgggcgcgacggcggccgccgtccgcaggcgccgctgcccaacgggctcgcggtgcaggttcactacagcaacgcgcgggcgcaaggcgaaatgcgcctcggcgacgcatggcgcgtgaagccgagtgacgtgctgctcgcggagctgcgtgcggcgttcgacggcagcgtcgtcgaaatcacgtactgaccgcgcttcagccgaaggctgtcgcgctacgcggcccgccgcatcgccatcgtgcggtgcggcgggccgttttgcatgttcacgcaaagcgggtcttgggctggccatccggacgctatacaatccggcgctggccgcacgaacgcggcgccgatcgccgctcgtccggcgggtggcgccggtatcgcgcgcatgaacgggggcggatccgtgcggcgagcggcgatatgcgacaaggccgtcccggaaccggatgcgggaaatggcccgtcgcgacaacaatgaactgacagtcaccacatgaccatggccaatgggaacccgccgcagcggatcctcgtgatccggatcgatttttgggcgacatgctgtgcacgacggcgtttctcggtgcgctgaaggagcgctggcccggcgcggaactgcatgtggtcgcgaaccgctacaacgcggccgcgctggccggaaacccggacgtggacgtgatccacacctacgtgtacagccgccaatgcgaacgcaacgaccgtcccgggcggatgcgtgcgttcttcgaccggctgcggctcgtgcgtcgcctgcgccgcttgcggttcgacctcgtggtcgtgccgaacggcggcatgcatcgcagcagcatgcagttcgcgcgccagatcggcgcgaaggattgccgctggcacgatgccgagaccgaattcgacgatcgcaagcccgagcatgtcgcgcagcggccgatgtgccatgaggcgctgtcgggtttccggctcgtgcccgagctcggccgcgccgatctcgaccgtctcgagttgtcggtccatcccgaccgcgcgctgcaggacgcgtggcatcggctgctcggcgcgcgcacgaagccgcgggtcgggctgttcgtgacgaacaaggcggccgagcggcgctggcccgcggatcgctggcacgacctcgccgagcggcttgcgccgagcgtcgacgtgatcgtgtttcgcgacccggccgtgggccatgcgcccgaggacgactcgtggcgcgacgtgagcgcccgccatgtcgcgccttcgtcggtcgccgagctcgtggcggccgcgagcctgctcgatgcggtcgtctcggccgacagcgccccgtgcacctcgcgtcggcgctcggcgtgcccgtcgccgcactgttcgaggatcgtcccgagaaatacctgcgctggcatccgctcggtgtgccgcacgtgatcctgcgcgccggcgcgaccgtcgacgcgatcggtgtcgacgcggtcgagcgcgcggtgcgtcatctgccgccgcaggccacccatcgcgacgaaccgctggccgacgcagcccgcccgcggccggctgccgcggttgcggcgccggtgatcctggcggcctcgtagcgtcacgggcgtcacaagcctccgcgtgcggtaccggcccggcaccggcgcgcggtgcgcctgccgggcatccctgcatgagcagggccgtatcaggccgccgcgcggccgattcgccaggccgcgccggctgctgcaaaatcctgtacattgccagccttgttcagccagccggataccccaatcgccgtggccctgttttcttccgcccgcccgcccagaaccatcctcgtggccgcgccgcgccgtatcggcgacgtgctgctgacgacgccgctcgtccgttcgctgaaggcccgctggccggatgcgcagatcgacatgctggtgtttcgcggcaccgaaggcgtgctcgagcacaatccggacgtgcggcacgtgatcgtcgtcgcgcagcgcgcgggtttccgcgagcggttgcgcgacgcgttgtcgatgtggcgccgctacgatcttgcgtgcgcggcgctgagctccgaccggccgcgcttctacagctggttcgcgggccgcaagcgggtgggcctcgtcgatccgaaccgcgtgacgtggctcacgcgaatgatgctgaacgggatcgcgatcaatcatcacgaatccgcgcatacggtcgtcagcacgctggcactcgcgccggtgatcggcatcgagccggtgtccgaggtcgtcgcacccggcatcggcgacgatccggcacggcgtgcgcgcttcgacgcgtggctcgccgagtcgcccgcgatccgcgccggcaagccgctggtcgtgctgcatccgtatccgatgttccgttacaagcagtggcggctcgacggctgggtcgagatgatcggctggctgcgcgagcacggctatgcggtcgcgctgtcgggcggcccggccgacagcgagcgcgagtatgcggagcaggtcgcggccgaagcgggcggcgacgtgctgaacctggtcggacgcctgacgttcggcgaaagcgccgaactcgtacggcgcgcacggctcttcatcgggcccgacaccggcgcgacgcacgtcgcggccgcgaccggcaccgacacgatcgcgctgttcggtccgtccgacccggtgcgctggggccgtggccgcagcactggccggcgaccgagaatccgtggccgctgcgcggctcggggcggcacgggaacgtgtggctgctgcagggagggcgattgcgtgccgtgccggcacgagggctgcgagcgcaaggtcgacagccgcagcgactgcctcgtcaatctcggtgcgcagcgcgtgaaggccgcagcggccgagatgctcgggctgaatccgccgggcccggccgcggtcgccgtcgatacgtcacggctgcatcgcgccggatccgactgacgcgcgggcggcgcacgccgttctttttgtcgttctggatggcctgtttcgcgacgggccgcgccgaacgcgcgcagcccggtcgcttcgacggcgggtgccgccgccgccgaagtcggtcggcagcacggcgcaggccgccgcgcgttaagcgttacgcgctgcgccggatcgccgacgtctcgcgcggcagcgcctcgccgcgctcgccgcagccgagcaggataccggccagcagcacgatcaggtgcccttcggcgaaatcgagcagcaacgaattcgcgagactgccgatcgcgaagatcgcgagccaggcgagcagcagatgccgcgagcgcggatcgagcgcgcggctgccgcgtgcgatctgcacgatcaggttgatgaacagcagcaggccgagcgtcccgagctgcacggccatcagcaggtattcgttgtgcgggttcgacgtcagttggccttcggcggccgtcttgccggccgtgagtttctcgaattcgaattcgaggccgcccgcgccatagccgatcagcggccgctggcgatacagttcgaagcccttcttgtaccactcgaggcgcagcccggtcgacgtcgccgcatcgctctgccgatactgctgcacttccgacacgaccttgacgagccggccgttgtgaaccgtgcaagccgcgaccaccagcgcgatgccggccaggacgaacaccccggcgacgagccccgcgcgcagcgccgaccggcggcgcagcaacagcacgaaccgcaccgcgacgacgaggatcagcagtagcgcgatgacttgcccggtgcgcccctgcagcatcacgaagacgttcaccagcgaccacgcggcgatggcggcgcaagcgacgcgcgacagcgtcgtgcgcgccgacagcgcgaaatcggcggcctggtagaacagcagcgcgccgaacatgccggcggcgatgtggttcttgaacacccatgcgcgcgacagcggcagctgggtcgcatgcgcgggcccgatcgcggtcagcccgagatagttggtcgtcgacagcagcaggatgacgcacagcgtggcgaaccagcagcgctgcacgatcggcgcccagttcgaatgacggaacgcgaccacggcaaaggcagcagcagcagcttgtcgtatttggcgacccagttccacgccttggcgtgcggcgcaaccgtataagtgacgctgacggccagcgcggcgaggatcagcagtgccgcgagcgaagcctgatcggtgaccaacgagcgcaggtcacgccagaattcggggagatgacgagcgcggcggcgaacagcccgcagaagacgttggtcagcgcggtcgagaccggcaccatgcagagcgcggcaacggcgaaggcgcgggcggcggtcaggcgccgcgtggcgggagcggaaaacgaaagcatcggaacctgtcgaatggacgaatgcggcttgcgggcatcgtgctgcgcgccgcgtccccggcgggagagccgggacgaacggcgcagagtatacgcgaagcaggggcgtttccgtgctgttttcggggcccgatcagctgaacgcgcgcttgatccgcgagcgcagcagcgcgcgcttcaggcgtccttcgatggccggcgtgtcgagcgcgacgcgcgtgccggccggttcgccgcgatgcaggtagtagcggtcgaacgtcgcctgggtcatgccccatttgttgaggaactggcggcgcccgtcgttcttgacgatcttgcccgtgctcttctgctggaagtggtagacgagactgtcgccggcgccgatgaagatccggcagccggcgtcccagaatttcatcgagaaatcgttgtcgctgctcatgccgggcgacagttcgctgctgtagccgccgatccggttccaccagtcgcggtgcacgagcgtcggcggccaggtcgagccgagccagtccgcgcgcgcgagcttcggggccgccgcgacgaggcccgccgcatcgaaatgctcggcgtcgcggccgaaattgctgaccacgacgcacgggttgcgcgtgtcgaccggctcgatcatcgtgcccgacagcatgaacaggtcggtcggcatctgttcgatgcggcgcacgagcgccgtgtcccagccggggcagcagaacatgtcgtcgttcatgtagacgacgtagtcgcgggtcgcgcgcggcggcccagttcaccgcatggcagatgccgatattggtcggcgacgcggtatgttcgatgccttcgctgcgcacccagtcgagcgtaccgtcggagccgtcgttcacgtggacgatgatctggtggtcgtacgcggagtggcggcgcaggctgtcgacgacgagcttgaggtacggcaggttgttccaggtcggaatgatgatggagaacatggcggtcggattcggtggtcgtcgtggcgggcggcgcgcggcgccgcctgtcgggcgagcgggcacgcgcggcgcgggcagcccggcattgtaacgccgcgccggtcgcgtgccgggcgggcgttcagcgcgcccgttcgtggccgagcttcaggaaccggtaatacacggtttccgcgttgaacacggcgatcatgaagccggcgcggccgtcgaggaagccgcgccgcagcacgtaggtgcgcacgaacgcccaggcgccgcgcgcgagcgccttgccgaagccgccgcgctggccggccgcgcggcggcgcgcgccggccgtcgaatacgcgtcgagcttgcgcacgacggtttcgaaatcctcgtacgagtagtgcatcagcttgccggacaggcgctgcgccgcgccatcgaacacgaggcgttcgtgcacgagatcgtccgagaagcgcgcgcagccgcgccggaacaggcgcggcacccagtccggataccagccgctgtgatggatccactggccgcagaagctggacagccggtcgaccgcatagacctgcgcgctcggtgcgcggatcgtgtcgcggatcgactgcgcgagttcaggcgtgacgacttcgtcggtatcgaggacaggatccagtcggtgtcgagcgcgtcgagcgcgcggttcttctgcgggccgaagcccggccagtcgcgctcgacgatcacgcgcgcgccgtgcgcctgcgcgatcgcgacggtatcgtcggcgctgccgccgtcgatgacgacgacgtcgtcggcgaacgacagcgcggcaaggcactgcgcaagccgcgcggacgcgttgagggcgatgagggcgacgccgagggagggttcagccatgaaatcgtcggaaaggcggagaaaacggtgagcggcagatacccgcgggccggccgccggccgcgccggccctgcgtcggccccgtgtcggccatgaccgtgcccgccggggcggtgcggctataatgttgagcccttttcggcacccgcccgacagggcgacctcccgggcggccatgcccgggcgcgcttcgcggctcaagaaggattgccttggaaacccagaacactcttcgcaaaccgatggacggcacgggcacctcgcccgtgacggtcctcaagcgcctgtggccgtacatccggccgctgatcggcatcgtggtgctcgccgtgatgacgatgggcgtcgtcgcggccaccgaggccggtatcccggcgctgctcaagccgctcctcgaccacggcttcggcgcgcacggcagcgaccgtgcgaaatggtacgtgccgatcgcggtgatcggcctcgcgctcgtgcgcggcgtgtcccagtacacgtcgaattacctgctcaactacgtatcgaaccgcatcctgctgcaactgcggctcgagatgttccagcggatgatccataccggcgcgtcgttcttccagcgcgaaaccgcgagcacggtgatcaacgcgatcgtgttcgaggtcaaccagatcctgtcggtgctgacgggcgtgatggtcacgctggtgcgcgattcgctgacggtgatcttcctgctcggctacctgttctacctgaactggcggctcacgctgatcgtcgcggtgatcctgccgggcatcggctggctcgtcagcaagatcaaccgccgcctgcgccgcctgaaccgcgagcaccagacgctgaccaacgagctgtcgtacatcgtcgaggagacggtcggcggctacaaggtcgtcaaggtgcacaacggcgaagcgtacgagatcgaccgcttcacgcagatgagcaagcgcctgcgcggctacgcgatgcgcatgacggtttccggcggcctcgctcagccgctcacgcagttcctcgcgtcgatcgcgctcgcggtcgtgatcacgatcgcggtcgtgcagtcgtcgaacgaccagacgacggtcggcggcttcgtcgcgttcgtcacgtcgatgctgctggtgatctcgccgctcaagcacctgatcgacgtcaaccagccgctgcagcgcgggatgacggccgccgagctgatcttcgggctgatcgacgagccggccgagccgcagggcggcggccggctgttgccgcatgcgcgcggcgagatcgagttccgcaacgtgtcgttcgactacggcgcgaccgagcggccgacgctcgaccgcatctcgttcaaggtcgcgccgggtgaaatgattgcgctcgcggggccgtccggcagcggcaagacgacgctcgtgaacctgctgccgcgcttcttcgacccgaccgacggcgcgatcctggtcgacggcgtgccggtggccgactacgacctccacgcgctgcgcggccagatggcgatggtcagccaggacgtcgtgctgttcaacgacacgatcgccgcgaacgtcgcgtacgggcagacgcccgaccgcgcgcgcgtgcaggccgcgctcgaggccgcgaacctcgccgatgcggtcgccgcgatgcccgacgggctcgacacgctcgtcggcggcaacgggatgcggctgtccggcggccagcgccagcggctcgcgatcgcgcgtgcgatctacaaggacgcaccgatcctgattctcgacgaagcgacctcggcgctcgactcggaatcggagcgccacgtgcaggccgcgctcgaacggctgatggaaggccgcacgacgctcgtgatcgcgcaccggctgtcgacgatcgagcgcgcggaccgcatcctcgtgctcgaggccggcaagatcgtcgaagagggcagccacgacgaattgctgcgccacggcggcctctacgcgcacctgcaccggatccagtaccagcagcaggcggcgtaacgcgcggttacgtagccgcgcgataccgtgtgctagtcttcatcgggcagttcgagtggtttcgttcgacgtgacgacacggagggaacgcacgatgaagaagatgcacgggatgatgctggccgcggtgatcgcggcgggtttcgccgcaccggccgcgatggcgcaggaccacgacaaccaccacgatcagggcggccacggcatgcagcgtggccacggcccgaaacatatgccgcccggccagatgcgtcatgaggacgacgtgccgccgcgctgggccgaccagccgcgccgcgagtggcacaagggcgaccggcttccccgagttccgcgatcgccagtacgtgatcgacgactggcgcggctatcacctgagcccgccgccgcgcggctatcaatgggtcggcgtcggcggggatcacctgctggtgcagatcggttccggcatcgtgctgcggatcggcggctgaccttgccgatcgtccggcgcgtatcgcgatgccgcgatgcgcgccgggcagccgcgtcactttgccgctgcgtggcggaaccagcggcgctcgattctcgacatcacccagcacacgcccagcgcacacacggtgccgagcgtcacttcaccgagccgcatcagcggaacgtcccacagcgggccgttgcccggaaacagcagcacgatcgtcgcggttacgccgccgagccgtgccgcgctgccgacgttcaggcaccagcagcacacgatcacgaccgcgacggtaatcgcatacgcgacgaggcggtcgccgccgagtgccgcaccggcgaagccgagcacgccgccgaccatcgcgccgatgaactggtcgcgcgacagcgacatcgtgtccgagtagttgtgctgcgtgacggcgatcgcggtgatcgccgcccacacggcctgctcggtatgcatcgcgcggccgatcacgtaggcgaggcacgcgctgcacacggcctgcagcgccatcagtccgccttgcgcgagccgttcgctgaatgacagccccttgaacagatcgaagatcgactgctggatctgctggcgggcttcgttgagtgtcctgatcgtatccatcatgcgttgacctggaagcgggtagcggcggcgcgcgggcgtcagtgcgcctgttcgggcgacgcggcggccggttcgtcggccgccgcgtcgccgttctcgacgcgcgtttcgggcatcacgagccagaccagcagcacggccagcgcgccggcgcccgcgagcccgaagaagctgacggcattcccgaaatgatcggcgacgtagccggcagccgcggtgctgagcgtcgcgccgatcccggccgcgagcccgaacagcccgatgcacaggttgtagcggcccttgccgcccgcgacgtcggccgcgatcagcggcagcatcacgccgaacacggcggcgctgatgccgtcgagcatctgcaccggcaccagcaggtacgggctgctcacgcccgcgaacaacagcgcgcgcaccggcagcgcggagaagccgagcagcaggatcggccggcgcccccagcgctgcgcggagcggccgacccacggcgacagcatcgcgacgatcgcctgcggcacgatgatgcacgcggcgatcacgagctgcacgttctcgcccatcccggccgtgacctcaccggccgcgaggttcagcatcgccgcgttcgacaggtggaacagcacgacgcacgccgcgaagatcagcatccggcggtcgcgcagcagttcgagcagtgtctcgcgttcgcctgattcgtcgcggtcgccgtggtcgtcgggcttcgacgattgcgggatcacttcgtgggtcggctggatcatcgcgagtgcgaacagcgcgggcaacgccagcacggcggtcagccagaacaccgcacgcgcggagaagtattcgccggtgagccccatcaggcccgccgcgaccgcgctgccgatcgatgcccagcgcgcattacggccgagccggtcgccgaggtcggcgcggccgacgagcgagaacgagatcgcggccatcgccggcacgagcatgcagctcgcgaaaccgtggaacacctcggcggcgatcaccggcacgatcgtcgggctcgacgcgagcagcaccgcggacaggatgatggccgcgatcgcccacgcggccgcgcctttcttgttcttcagcgcatcgacggccgcgccgcccggcacctggctgaccatcgcgctgatcgtgccgatcgacagcaccatgccgatctcgccctgcgtccacttgtgcgacgcgaggtaggacgcgatgaacggaccgaaccctgtttgaacgtttgcaacgaagaagttgagccagtcgagggaccggagactgcgtacgctgacggaatgcttgatcgtcatcgggtcgcactcgcagacgaagccggtgccggggcaacgggcgggtagaccgcgacgatcggcttgtcggccgcgtagggcggcgacgccttgatctgtgcgtcgttcaggtcgagctgcggacgcagcgccttgtcgcgcgtgacgaagcgcagcgcgccccagctcgcggcgatcgaacggcggtcggtattgacgagcccgccgaggtcgagcacgacagcctgcggctgcgacgcgcggtcgatcagcacgtcgacgatgcggccgatcttcgtgccgttcgggcgctcgacgtcgctgtcgagcaatggcaggcgcgtcgcgggcgaggccgcggccgaacccgacagcggcacggccttgggccgcgcggccggcggcaggtcgcccgacggcacgtcgagcacgatcggctcctgtttgccgcccggcgtgaagcggaacacgttccacgggaagatgaccttgcggtcgccgacgcccatgaagccctgcaggttgacgaccatctcgcgcggcttgccgctcgcgtcggtcaccatgtcgaccgcgcggccgatcaccttgccgttgcggcgcgcgacttcgctgtcgagcagcgcatggatctgcgtgcggtcgagcgggcgcgtcgcgacgatcggcgcgggcggtggcggcggcggagtcggcgattcggggcgctgcacgggcttcggccgcgtgacttcgcggtgcggcttttcggcgcttccggcccttccggctgcgtcggcgccggcacgggcggcatcgtcagcggttcgccggcggtttcctggacgggctcgacgagcgcctcgctgatcggcgcgggcggattctggaccggcagcagcccgcagccggacagcagcgcggcggcggcgagaatcaggaagaccgtcgaggacggcaacgacttgcgggatgcgggaaacggaagtccgccgctcattgacactcactccatgggtcgggggcggcccgagggcacgcggctggcgatggatggcgggtgcgggcggcgcaccacgcgaggagattttaacgtgtcttcctttcagggccgatttcgacggcttgctggaggcggactgtcgggaaaaggtagggatcggcggcggtcgcgtcgctgtggggcgacggggaggcgaccgggcgagggccgtgcgcatgggtgccggcccagcctgccgccgtcatggcgggcaggcgcgggcgctgcatgaaagcaggggaaaccgggcgtcaggcttccgggtaccacgcgtcggagaattcgctgacctgcacgtcggtcagttccggacgggcggcgagccaaccgcgcacgagttcgcgatcggcgtcggtcgtcgtgccgcgcggtgcgccggagatcacgtacgcgccgatgccttcgtccgccgacgcgacggtcagcagaccgttcgcttcgacgaagtcgatgaacgcgtcgatcagctggccgcgttcgaggtcggtcagttcgttgcggtagtgcgcggttgcgttgaacgcgagttcctggaattcgccgatgtggagtttcttgcgctggcggcggttgtggccttggctcatggtgtgtggtgagtgaatgagaggggaatggatcgtgcggccggaggcggcagcgaaaggatgacgcatggcgccgtctcgatcgcgtgtcatcgcggaggcgatcgtgaaaccattcgtgaacattgacgcgatgggcgtttcgtgatgcggcttggcccggcggctcatcgcgcgcatgaccgaatgatacagggacggcgggctgcctcggctttgcgatggtcggcggctactcgaacgacaacgagggtcgcatgtcggacgatcgcaatgcgttcattggacgtatcgatctcgaggcgggcggcctgtttttccggtgttctgaaatgccgaccgatacgtgggaaaagctggccgcattcacgcgcgaagaactgggtcgcccgttgatcggcggcgaactgaagatcgctccgtcgtcacgcctcgaagaggatctgtatgtgaccggaatcgacgcaatcgaatttatcgacaagtgggccaaaacgtttggcgtgcaggccggcgattttcctgcggccgctatttcggcccggaggaacaggatagggtgacgacgtttctcgcgatgttttccgagcgttatcgcaaaccaccgcgcgtgtcgttgacgctcggcatgctggaggaagcgatgcggctcggccgttgggacagcaatgcgatcgagccggccgcaacgttaaccgctcacacgaaataaccggactcgaacggccgttacatcagcacgatgtcgtattgctcctggctcaaattcgactccacctgcagcgacaccggcttgccgatgaagtcgatcagcatcgcgagatgttgcgattcctcatcgaggaacaggtcgatcacctgctgcgcggcgatcacgcggaattcgcgcgggttgaattgtcgcgactcacgcaggatctcgcgcaggatgtcgtagcacacggtacgcgacgttttcacctggcccttgccctggcaggtcgggcacggttcgcacagcacgtgcgcgagcgattcgcgcgtgcgcttgcgcgtcatctcgacgagcccgagctgcgagaagccgttgaccgtcacgcgcgtgcggtcgcgcgacagcgccttcttcagctcggacagcaccgcgtcgcgatgctcggcgttctccatgtcgatgaagtcgatgatgatgatcccgccgaggttgcgcagccgcagctgccgcgcgatcgtgtgcgcggcctcgaggttggtcttgaagatcgtgtcgtcgaagttgcgcgcaccgacgtaaccgcccgtgttcacgtcgatcgtcgtcatcgcctcggtctggtcgatcatcaggtagccgcccgacttcaggtcgacacggcgcgacagtgcgcgctggatctccgtctcgatgttgtacaggtcgaacagcggccgttcacccgtgtagtggtgcagcttcgggctcacggccggcgtgaactcggtcgcgaattcggacaggcgctggtaggtctcgcgcgaatcgacctggatgcgcgtcgtgtcgtcgttcgcgaaatcgcgcagcacgcgctgcgcgagatcgagatcctggtacagcaggctcgtcgccggcagccgctgcgcctgcccgacgatcgtcgcccacgtcttgcgcaggtacgtgacgtcgccggcgagttcgtcggaggtcgcatcctcggcgatcgtgcgcacgatgtagccgcctttctcgtccggcgggatcacggcggtcagccgcgcacgcacggcctcgcgctcggcctcgctctcgatcttctgcgagatgccgatatgcggctcctgcggcaggtagacgagcgtgcggcccgcgatgctgacctgcgtcgacagccgggcgcctttcgtgccgatcggatccttgatcacctggaccatcagcgtctggccctcgaacacggtcttttcgatcggctggtgcggcgtgcccgactgcggctcgcccgcgaggcgcggatgccagatgtcggcgacgtgcaggaacgccgcgcgctcgaggccgatgtcgatgaatgccgactgcatgccgggcagcacgcgcacgaccttgccgagatagatgttgccgacccgcccgcgcgacagcgtgcgctcgacgtgaagctcctgcaccgcgccttgctggacgagtgcgacccgcgtttcctgcggcgtgaggttgatcaggatttcttcgttcatggtgggattcagaaggcgacacgcgcggcgcgcaacagcgccgcggtctcaaaaagggcagacccatgatacctgaatgggaaccgtcgattcgctcgatgaactcggcggcgcgccctggatcgcgtacgcgccggctttgccgaacggctcgcccgattcgacgtagcgtgcatacgcatcgcgcgacgcggccgcgaagcgcaccgacgagcgcgacagcgcgggcggcagcagttggccgtcggcatcgatcacggcgacggccgtcagcacttcgtgttcgcggcccgcgaggcgggtgagcatcgcgagcgcgtcgtcggcgtcggccggcttgccgaggatcgcgccgtcgatcgtgacggtcgtatcggcgaccagcaccggcgaagccggcttgccgctcgcgacgaggcgcgcacgcgcggcctcggccttggcgacggtcacgcgccgcacgtaggcatcggcggcttcgccgggcagttcggcctcgagcgcctcggcgtcctcgtcggcgcgcggcagcagcagctcgaagcgtacgccgatctgctgcagcagctcctggcggcgcgggctttgtgaagcgaggtaaagggtcgggaaaagtgcggggacgtgctggacggcatggtgtcgttatctcggtgagcgcgcgaggcgcgcgtctcgaggacgacacgtcatgcgcggtggtaggggtgattctgcgtgatgctccacgcccggtaaagctgttcggcgagcagcacgcgcaccatcccgtgcggcagcgtcatgctcgagatgcgcagcagcacgtcggcacgcgctttcagttccggatcgagtccgtcggcaccgccgatcacgaacgcgacgtcgcggccgtcctgctgccagccgggcagcgcctgcgcgagctgcatcgtggtccagtcgcggccgcgctcgtcgagcgcgacgaggcgcgcgcccttcggcaacgcggcctcgatcttctgccgctcggccgccatcacgctctcggcgctgcggccgcccgaacgtagttcgggcttgatctcgcgcaactcgatgcgcagttccggcggcatccgcttcgtgtattcgtcgaagccggacgcgatccagcccggcatcttgtggccgaccgcaagaatgaaaagcttcatcgggagacgcgtaacgactcggggctcaacggcggcgggcggccgtcttgcgcgccgggcgtgcgggcgcggcttcttcctcgtcctcgtcgccttcgctggccgtggcgaagccgttcccttgccgccgccgagcttcatccgcacgggcttgtcgccccagatttcctcgaggttgtagtactggcgcagggccggctgcaggatgtgcacgaccgcgtcgccgcagtcgacgagcacccattcgccggtgtcttcgccttcggagctgacgatgtcgccgccggcttccttgaccttgtcacgcacgctcgacgcgagggccttggtctggcggttggaggtgcccgaagcgacgaccacgcggtcgaacagttcggtcaggtggctggtgttgaacaccttgatgtcttgcgccttgacgtcttcgagggcgtcgacgatcacgcgctgcagtttgcgaatatccatggattcaggaatggtagaggcgatgttgaagaatataggcccatacggcggccggcacatgctcggccgatgcgtcgggcatttgtgcatggcgcgcgatgcattcgcgcaggtgtgcgcggatgtcggtcgcggcgatgtcgaacgaaagggtcgtatcgatcagcaggtgcccgcccggcgtggccttcagcacgtcggcgccggcctgccgcgcggcgatttcccgcgcgacgtccggcggcgccgcgccgagatcgaagcccgggcgcgtcgacacgcagatgtgcgcgtagtcgaacagcgtgcgccagtcgcgccacgtgtcgaggcgcacgagctggtcggcgccgatcagcagcgacagcgacgcgtccgggccgatccgcgcgcgccagcgcgcgagcgtctcgaccgtgtaggtcgggccggcgtgctcgatctcgtcggtggcgacggtcacggtcacgcccggcagggacagcgagccggcggccgcgcgggtcatcgcgagccgatgctcggcggccgacacgtcgcgcttctggtacggctgcccggcgggcagcagcacgagttcggtcaggccgagcagcccggcgaaccggcgcgcgagcgcgagatggccgtcgtggatcgggtcgaaagtgccgcccagcaggccgatacgacgcggcagcggggcggggcgggcgatggtgtccagaaaaacgtgtcctgttcttggggcggcgaggcgcggcgggctcagacccagtcgcgcggcacgaggaactcgctcaggcgcgcttccggcgagcccggctcgggctgccagttgtagcgccagttcgcgaccggcggcatcgacatcaggatcgattcggtccggccgccgctttgcaggccgaacagcgtgccgcggtcgaacacgaggttgaattcgacgtagcggccgcgccggtaagcctggaagtcgcgctcgcgctcgccgtacggcagcgcggcacgacgctcgacgatcggcaggtaggcgttcaggaacgcgtcgccgacgctttgcataatctcaaacgagcgttcgaatccgggctcggagaaatcgtcgaagaagatcccgccgacgccgcgcgtctcgttgcggtgcttcaggaagaaatactcgtcgcaccacgccttgaaacgcggatagagctcggcgccgaacggatcgagcgcgtccttgcaggtctggtggaaatgccgcgcgtcgtcctcgaacgcataaaccggtgtcagatccatcccgccgccgaaccagaagaccggcgcctcgccgggtttcgtcgcgatcagcatccgcacgttcatgtgcacggtcgggcagtacggattgcgcgggtgcagcaccagcgacacgccgagcgcctcgaagccgcgaccggccagctgcggacgcgcggcgctcgccgacggcggcagcgcgtcgcccgcgacgtcggaaaaaccgatccccgcgcgctcgaacacgcggccgccttcgagaatccgcgtgcagccgccgccgcgcaggcgctcttgcggcccgcgctgccacgcatcggtcgcgagcggcgtgccgtcgagcgcgccgagcgcgtcggcgatgcgtgtctgcaggccctggaggtacgtgcgcacgcgcgtcacgtcgtaggtcgaatcggtcatgtctggactgggtgcccccgtgcgaagcgggggccgtaaaggcatctgccgggcattctatcgaaccccggcagaggacccgccgccgcgcgagggcggggcggcggttgcaacgttacgcgctcttgcggttgagcgcgcggaagccgatgtcgcggcggtactgcatgccttcgaaattgatctggttgatcgtgtcgtacgcatgctgctgcgcttcgcgcaccgaatcggcgaggccgaccacgcacagcacgcggccgccggacgtcgtcagcttgtcgccgtcgagcgtcgtgcccgcatggaacgtgaccgcctgttcggtctcggccgggatcccgttgatgcggtcgcccttgcgcggcgcgtccggataaccgtgcgcggccagcacgacgccgagcgcggtgcggcggtcccagtcgagctcgaccgtgtcgagcgtgcccgcgatcgcctgctcgacgaccttcgagaaatcgctcttcaggcgcgccatgatcggctgcgtttccgggtcgcccatccggcagttgaactcgagcgtgcgcggattgccttccttgtcgatcatcaggcccgcatacaggaagcccgtgaagcggatgccgtccttctccatcccgcgcacggtcggcatgatgatctcgcgcatcacgcgtgcgtgcatctgcggcgtgacgatcggcgcgggcgaatacgcgcccatgccgccggtgttcgggccgcgatcctcgtcgagcaggcgcttgtggtcctggctggaagccagcgccagcgcgtgcttgccgtcgaccatcacgatgaagctggcttcctcgccgtcgaggaattcctcgatcacgacgcgcgcgccggcgtcgcccagcttgttgcccgacagcatcatgtcgacggcctgatgcgcttcttccagcgtcatcgcgacgacgacacccttgccggccgcgaggccgtcggccttcacgacgatcggcgcacccttcgcgtcgatgtacgcgtgcgcggcggcgacgtcggagaacgtttcgtactcggcggtcgggatgccgtggcgcttcatgaacgccttcgcgaaatccttcgagctctcgagctgcgcggcttcgcgggtcgggccgaagaccttcaggccgcgtgcgcggaacaggttgacgataccggccgcgagcggcgcttccggcccgacgagcgtgaacgcgacgccttcgctttccgcgaaatcggcgagttcgtcgagcgccgtgatgtcgacgttcttcagacgctcgtcctgtgccgtgccgccattgccgggcgcgacgtagaccatctggacgcgcggcgactgcgcgagcttccacgccagcgcatgttcgcggccgccggaaccgacgacgagtagtttcatgggattccccgcagactagaaaacagggcggccggcacgctcaggcgcgccggccgcggattcgatcgggccgccgccgcaaagggtgcgcggcggccggcatctcattcctcgacgatgacggcgttcgtatacacgtcctgcacgtcgtcgaggttctcgagcgcgtccaggagcttctgcatcttcgctgcgtcgtcgccggtgaattcgacttcgttctgcggcttcatcgtcacttcggcgagttcggccttgaagccgccggcttcgagcgcgtccttcaccgccgagaatgcctgccagtcgcacagcacttcgatcgagccgtcgtcgttcgtgttcacgtcgttcgcgccggcttcgagcgcggcttccatcagcgcgtcttccgacgtgccgggggcgaacaggaactggccgacgtgatcgaacatgaacgcgaccgagccgtcggtgcccatgttgccgccgaacttcgagaacgcgtggcggacttccgcgaccgtgcgggtgcggttgtcggtcagcgtgtcgacgatgatcgccgcgccgctgatgccgtagccttcgtaacggatttcctcgtagttcgcgccgtccgcgccgccgacgccgcgatcgatcgcgcgcttgacgttgtccttcggcatgttcgcgtcggccgccttgtcgaccgccagacgcaggcgcgggttcgagttgacgtcgccgccgccgaggcgcgccgcgacctggatttccttgatcaggcgggtccagatcttgccgcgcttcgcgtcggccgctgccttcttatgcttgatgttggcccatttcgaatgaccagccatacctttctccgtgcccgggcgcagcgcgggcgattgtttcaatgtgtcgttgagtcggcggccgtgtcggcgggcatgaagccgcggggccgcgcgtgtcgagtggatcgagattttatcacgcggcgaccgccggatcggggccgccgcgcatggccgaacggccgggtgggccgccgcgagccgggctgcgcgccgcgcggccgtgccggggctcagttcttggtgccgaacaggcggtcgcccgcgtcgcccaggcccggcacgatgtacgcgtgctcgttcaggtgcgaatcgagcgacgcgacgaacagcttcacgtcggggtgcgcgtcctggaacacctgcacgccttcgggcgcggccaccagtgcgacgaacatgatgttcgcggccggcacgttgcggcgtttcagcacgtcgaccgcgtgcacggccgagtagccggtcgcgaccatcgggtcgcacaggatgaagatgcggtcttccagatccggcaggcgcaccaggtattcgaccgggcgatggtcgtcggcgcggtacacgccgatatggccgacgcgcgcggagggcaccaggtcgagcaggccgtccgacatcccgatgcccgcgcgcagcaccggcacgatcgccagtttcttgcccgcgatcaccggcgcgtcgacctcgacgagcggggtttcgacccgcttggtggtaatcggcaggttgcgggtgatctcgtaacccatcagcagcgtgatttcgcgcagcagctcgcggaacgtacgggtggacgtgtccttgtcgcgcatgtgcgtgagcttgtgctggatcagcgggtgatcggtgatgaagagattcgggaaacggctgtcctgtttcatgacgggggtgccttggcggcaaaagaggatcgggggcgggggcgggcgcaagccggccgcgcgcttatgtccgcaattttaccaaggcgcgccgcatgatccggataatatcgacgtctcacgacaatccgcgcgcctgcgcccgcccgttcgcccgcctggcccgcccgtggtccgggcgccgaagcggccgggccgcgccggcgcgtgtcgccaccaaggaatcgacgatggatctcggcatcgaaggaaagaccgcgctcgtgtgtgcggcaagcaggggctcggtcgcggctgcgcggaagcgctggccgcggagggcgtgaacctcgtgatcgtcgcgcgtacgcgcgacacgctggaggaaaccgcggaggaaatccgcgccggcgcgaacgtgtcggtgaccgcggtcgcctgcgacatcacgacgccggacgggcgtgcggccgcgctcgccgcgtgcccgcagccggacattctcgtgacgaatgcgggcggcccgccgcccggcgacttccgcgacttctcgcacgacgactggatccgtgcgctcgaatcgaacatgctgacgccgatcgagctgatccgcgcgaccctcgacgggatgatcgcgcgccgcttcggccggattgtcaacatcaccagttcggccgtgaaggcgccgatcgacgtgctcgcgctgtcgaacggcgcgcgctcggggctgaccggcttcgtcgcggggctgtcgcgcaaggtcgcggggcagggcgtgacgatcaacaacctgctgccgggcctgttcgacaccgaccggatcgcgaccacgctcaccgcgtcggcgaaggcgcagggcgtgacggtcgacgagatgcgcgcggcgcacgaaggagatcccggccggccgcctcggcacgcgcgcagagttcggcgcggcgtgcgcgttcctgtgcagcgtgcatgccggctacatcaccgggcagaactggctgctcgacggcggcgcgtatccgggcacgttctgacgcgcgtgtctcgaatcacgatcacgacaacaaccgaacgacgaaggaaccggagatgagcaaaacccgcatcgccttgattgcgcacgacgcgaagaaggacgagatcgtcgcgctcgcgggcgaataccgcgcgacgctcgcgcaatgccggctggtcgcgaccggcacgacgggcggccgcatcgcggacgcgcacgggctggaggtcgagcgcaagctgtcggggccgctcggcggcgacctgcagatcggcgcggaactggcggacggccgcgtggacatcgtcgtgttcctgcgcgacccgatgaccgcacagccgcacgatcccgacatcaccgcactggtgcgcgcgtgcgacgtgcacgacgtgccggtcgcgaccaacgttgcgaccgcgcggatgctgctcgacgatctggcgcggaacatgcaggaccgctgctagcccgcagcgtggcccgattgcccctgttgcgggcagggccatgcacggacggcggcgtcgggcgagaatcgtgcgtcgcgacgcgcctgccgccggctgttgcctgcatcggtcggcgccgtgcgtcggcgatccgaccatttcctgaccgacagacagacaaggagcgaaacgatgccgaaagcaatccgatacgaccagccgggcggcccggacgtgatgaagtgggtcgatgtcgaggtcggcgagccgaaggcgggtgaagtccgcattcggcagcacgcggtcgggctcaactacatcgacgtgtatttccgcaccggcctttatccgcagccgctgcccggcggtctcgggatggaggcggcgggcgaggtgacggccgtcggcgaaggcgtgaccgcgctcaaggcgggcgaccgcgtcgcgtacgtcgggcagccgccgggcgcgtatgcgcaggaacgcgtgatgccggccgagcggcttgtgaagctgccggacggcatcagctacgacgacgcggcgtcggtgatgctgcagggcctgaccgcgcactacctgctgcgccgcacgtacccggtgaaggccggcgacacgatcctgatccacgcggcggccggcggcgtcggcctgctggtgtgccaatgggcgaaggcgctcggcgcgaccgtgatcggcacggtcggctccgacgagaaagccgcgctcgcgaaggcgcacggttgcgaccatccgatcgtctatacgcgcgagaacttcacgcagcgcgtgaaggagatcacgaacggcgcgggcgtgcccgtcgtctacgactcgatcggcaaggacacctacatcggctcgcttgactgcctcgcgccgctcggctacttcgtcagcttcggcaacgcgtcgggcccgctgccggcgatcgattcgaaggagttctcgtcgcgcggctcgctgttcttcacgcggccgacgctgttctcgtacatcgcgaagcgcgccgatctcgaatccgcggccgccgagctgttcgacgtgatcctgtcgggcaaggtgaaaaccagcatcaaccagcgctatccgctcgcggaagtcggccgcgcgcatgccgacctcgagtcgcgcaagaccaccggctcgacgatcctcgttccctgatacatcccttcgtgccggcatcatgtcggcacgccctcccggcgggcggcaccggcgtgtcgcccgtcctgcccatcgttccgcccgccgttccccgccgcccgcgtttacacgtttttatacccgccccgatacctttgacccgtcctttacgtgcgttcccataaggttctagtcgtctgatttcgacgatggagaacaaaaaaatggatggggttttcatcggcgcactggtgctcttcaccacgctgatcctcggtttggttgccggttgcgacaagctcgtgcaatacggtcgcgggggcgagcatgacctggatgctctggctggcgggcgcctcgacggcgctgctgttcgcgtatctcgtctttgcgctgctgcgcgcggaggacatcgaatgaacgcgaacaacctgtttcagacgctgctcttcgtcgtcgtgctgctggcggcggccgtgccggtcgcgcgctacctgtccgccgtgatggacggcagttcgcgcgtcgtgcgcgtgttcgggccgctcgagcgcgcgctgtaccgcattgccggcgtcgatgccggcagcgagatgaactggaagcagtacgcgatcgcgacgatcgcgttcaacgcgctcggcgcgctgttcctctacggcctgctgcgcctgcagggcttcctgcccggcaacccgcagcaattcggcgcgatgacggtcgacggcgcgttcaacacggccgtcagcttcgtcaccaacacgaactggcaggactacacgcccgagcagaccgtcagctacctgacgcagatgctcggcctgaccgtgcagaacttcctgtcggcggcaaccggcatcgtcgtcgtgatcgcgctgatccgcggcttcgcgcgtcataccgcgcagacgatcggcaacttctgggtcgacctcacgcgcgtgacgatgtacgtgctcgtgccgatgtcgatgatcgtcgccgcgctgctgatgagccagggcgtgatccagaacatgaaggcgtaccaggatgtgtcggtgctgcaggcgagcacctatgcggcgccgaagctcgacgcgcagggcaatccggtgaaggacgacaagggcaacgcggtcacggtgccgaccccgctcacgaagcagacgctcgcgatgggcccggtcgcgtcgcaggaagcgatcaagatgctcggcaccaacggcggcggcttcttcaacgcgaactccgcgcacccgtacgagaacccgacgccgttcgcgaacttcctgcagatcttctcgatcctgatcatcccggccgcgctgtgtctcgtgttcggccggatgatcggcgaccgccggcagggcatcgcggtgctcgcggcgatgaccgtcgcgttcgtgctcgcgatcggcgtcgaggtgagcgccgagcagggcggcaacccgacgctcgccgcgcttcacgtcgaccagtcgacggcgcgctgcagccgggcggcaacatggaaggcaaggaaacgcgcttcgggatcgcgcagaccggcatcttcacggtcgcgacgacggccgcgtcgtgcggcgcggtcgacacgatgcacgattcgctgacgccgctcggcggcctcgtgccgatgctgctgatgcagctcggcgaggtgatctacggcggggtcggctcgggtctctacgggatgctcgtgttcgcgctgctcgcggtgttcgtcgccggcctgatgatcggccgcacgccggaatacgtcggcaagaagatcgaagcgtacgagatgaagatggtgtcgatcgtcgtgctgctcacgccgctgctcgtactggtcggcacgtcgatcgccgtgctcgccgatgcgggcaaggccggcatctcgaatcccggcccgcacggcttctcggaaatcctctacgcgttcagctcggcggccaacaacaacggcagcgcgttcgcgggcctgacggtcggtacgccgttctacaactggatgaccgcgatcgcgatgtggttcggccgcttcggcacgatcgtgccggtgctggcgatcgccggctcgctggccgcgaagaagcgcatcgcggtgacgagcggcacgctgccgacgcacggtccgctgttcgtcgtgctgctgctcggcacggtgctgctggtgggcgcgctgacctacgtgccggcgctcgcgctcggcccgggcgtcgagcacctgatgatgtggctgggcgcatgacgcgcggcgacacgttgaaaagactcgagagattgaagagatcgcaatgactcaacattccgcaacacggtccatgttcgatccggcgctgctgcgcccggcgatcgtggactcgttcaagaaactcacgccgcgcacgcagttccgcaacccggtgatgttctgcgtgtacgtcggcagcatcctgaccacgatcctgtggatcgcggcgctttccggccaggccgaggcgcccgcgggcttcatcctcgcgatcgcgctgtggctgtggttcaccgtgctgttcgcgaacttcgccgaggcgctcgccgaagggcgctcgaaggcgcaggccgcgtcgctgcgcagtgcgaagaaggacgtgatggcgaagaagctcaacgagccgcatccgaagtcgccgatccgcatcacgaccgcgaccgagctgcgccgtggcgacgtcgtgctggtcgaggccggcgacgtgatcccggccgacggcgaggtggtcgacggtgtcgcgtcggtggacgaatcggcgatcaccggcgaatccgcgccggtgatccgcgaatcgggcggcgacttctcgtcggtgacgggcggcacgcgcgtgctgtccgactggatcgtcgtcaaggtcaccgcgaaccccggcgaggcgttcctcgaccggatgatcgcgatggtcgaaggcgcgaagcgcaagaagacgccgaacgaaatcgcgctgacgatcctgctcgtcgcgctgacgatcgtgatgctgctggcaacggcgacgctgctgccgttctcgatgttctcggtcgaggcgatgaaggccggccacgtcgtgacgatcaccgcgctcgtcgcgctcctcgtgtgcctgatcccgacgacgatcggcgggctgctttccgcgatcggcgtggcggggatgagccggatgatgcaggcgaacgtgatcgcgacgtcgggccgtgcggtggaagcggccggcgacgtcgacgtgctgctgctcgacaagaccggcacgatcacgctgggcaaccgtcaggcgtcgacgttcgtgccggcgccgggcgtgaccgaggaagcgctggccgatgccgcgcagctgtcgtcgctcgccgacgaaacgccggaaggccgcagcatcgtggtactggccaaggaacgtttcaacattcgccagcgcgacatggcgcagctgcacgcgacgttcatcggcttctcggcgcagacgcggatgtccggcgtcgacctccccggccgcgagatccgcaagggcgcggccgatgcgatccgccactacgtcgagacgcacggcagccgcttcccggaagaagtgcgccgcgcggtcgacgaagtcgcgcgccgcggcagcacgccgctcgtcgtggccgacctgcatgacggtgcggcgcgcgtgctcggcgtgatcgagctgaaggacatcgtgaagggcggcatcaaggagcgcttcgcggagctgcgcaagatgggcatcaagaccgtgatggtgacgggcgacaaccggctgacggccgcggcgatcgcggcggaagcgggcgtcgacgatttcctcgcggaagcgacgccggaaaccaagctcgcgacgatccgcgagcaccaggcggccggccggctcgtcgcgatgacgggcgacggcaccaacgacgcgccggcgctcgcgcaggccgacgtcgccgtggcgatgaacaccggtacgcaggccgcgaaggaagcgggcaacatggtcgacctcgattcgaacccgacgaagctgatcgagatcgtcgagatcggcaagcagatgctgatgacgcgcggttcgctgacgacattctcgatcgcgaacgacatcgcgaagtacttcgcgatcatcccggccgcgttcgtgacgacgtacccgcaactgcgcgtgctcgacatcatgcacctgacatcgccggcctccgcgatcctgtcggcggtgatcttcaacgcgctgatcatcgtcgcgctgatcccgctcgcgctgaagggcgtcacgtaccggccgctcggcgccgcgtcgctcctgcgccgcaacctgctggtgtacggcctcggcggcgtgctgctgccgttcccgttcatcaagctgatcgacatgacgctcgctgcactcggctgggcctgaaccggccgccattgaaggaaacatcatgaaaacgttgattcgcccgctcgtcgtgctcttcgtcgtcctgaccgccgtgacgggcctggcttacccggccgtgatgaccgtgttcggccaggccgtgttcccgtcgcaggcgaacggcagcctgatcgagaaggacggcaagccggtcggctccgcgctgatcggccagccgttcgatgcgccgaagtatttctggggccggctgtcggccacggcgccgatgccgtacaacgcgaccggctccggcggctcgaacctcggcccgctgaacccgtcgctcgccgaccaggtgaaggggcgcatcgccgcgctgcgcgacgcgggcaccgacatgtcgaagcccgtgccggtcgacctcgtgacggcgtcggcgagcggcctcgatccggagatcacgcccgccgccgccgcgtaccaggtcgagcgcgtcgcgaaggcgcgcaacctgacgcccgacgcggtcgcgcaactcgtcgccgcgaacacgacgggccgccagttcggcgtgctcggcgaggcgcgcgtgaacgtgctgaagctgaacctcgcgctcgacgcggcgcaagccgcgcactgagcgcgtccggcaaccggcgcccggcgcggtcagcccgcgccgggcgcgttttcccgacggcgcttgcgccgtctttgcctttgcggcgatttggaacaacaatgctcgtactcgcgcgcatccgggcgctccgcctttctgacgcatgaatcgtcccgatccagaccaactcctcgacaagctgcagcgtgacgaagaaaagcagcggcgcggccagctcaagatcttcttcggcgcatcggccggtgtcggcaagacctacgcgatgctgcaggccgcgcgccagcgcctgcaggaaggcgtcgacgtcgtcgtcggcatcgtcgagacccacgggcgcagcgaaaccgccgcactgctcgacggtctcgacgtgctgccgctcgcgcgcatcgactatcgcggccgcacgctcgccgaattcgatctcgacggcgcactcgcgcgccagccgcaactgatcctcgtcgacgagctcgcgcattcgaacgtgcagggcgcacggcacatgaagcgctggcaggatgtgtacgaactgctcgacgcgggcatcgacgtctatacgaccgtcaacgtccagcacctcgaaagcctgaacgacgtggtcggcgcgatcaccggcatccgcgtgtgggagacggtgcccgaccgcgtattcgacgcggccgacgaagtcacgctcgtcgacctgccggccgaggaactgctcgagcggatgcgcgacggcaaggtctatctcgcgcagcaggccgagcgcgcggtgcgcaacttcttccgcaagggcaacctgatcgcgctgcgcgaactggcgttgcggcgcacggccgatcgcgtcgacgcgcagatgcgcgaataccgcgccgaccgctcgatccagcgcatctggcaggcgcgcgaacggctgctcgtatgcgtcgggccgggccccgaggcgccgacgctcgtgcgcgcggccgcgcggctcgccgcgagcctgaaggccgactggatcgccgtctatgtggagacgccgcggctgcagcggctgcccgacgcgcggcggcagcgtacgctcgacgcgctgaagctcgccgccgaactcggcgcggagacggccacgctcgccggcgccgacgcggtcgccgcgctgatcggctatgcgaaggtgcgcaacgtgtcgaagatcgtcgcgggcggctcgccgaaggtcgggctcgtgcgtcgcttcgcgcggccgttcggcgagcagctcgccgaacgcgcgggcgatgtcgacctgatgctgatccgtgcgtccgcgagcgacgaggcgcgcgccgcgccgctcgacgcgcgtgcgcgcgactggcgcgacgcgttcgcgcagttcggcacgcatcgctcgccgccgcggcactacgcgtatgcggccgcgatctgcgcggcgatcacggtcgtcgcgagcctcgtgtccgagcggctcgacctcacgaacctcgtgatgctgtacctgctcggcgtcgtgttctcggccgtgcggctcgggcgcggcccgggcgtgctgcagtcgttcctgtcggtggccgccttcgattatttcttcgtgccgccgcgcatgtcgttctcggtcagcgacacgcaatacctgctgaccttcttcgggatgctgctgacgtcgctcgtgatcagccacctgacgtcgacgctgacgcgccaggcgagcgtcgcgcagcgccgcgagcgccgcaccggcgcaatctatgcgatggcgcgcgagctgggcgcggcgctgacgaccgagcagatcgtcgagatcggcagccgtcacgtcggcgaggtgttccgcgcgcgcgtcgcgttcctgctgcccgacagcgcggacaaggtgcggcagaagatcgaggagcccgacgcggccgtcacgctgacgggcgccgacctcgacagcgacgtcggccagtgggtgtacgaccagcagaagccggccggccgcggcacggataccttgcccgcgacggtcgcgctgtacctgccgctgaaggcgccgatgcgcacgcgcggcgtgctcgcggtcgcgtcacgcgaaccgcgcgaactcgaggtgcccgagcagcagcggatgctcgatgcattcgccgcgcagatcgcactcgcgctcgaacgcgtgcactacgtcgagatcgcgcgcgacgcgctcgtcaacatggaatccgagcggctgcgcaactcgctgctgtcggcgatctcgcacgacctgcgtacgccgctcacgacgatcgtcggtttctcgtcgatgctcgcgaacggacgcgcggccgcacagggcggcgacgccgcggcggccgagcgcttcgcgcagcgcgagggcgaactcgtcgatgcgattcacgacgaggcactacggatgacgggcatcgtcacgaacctgctcgacatggcgcggctgcaggccggcagcctgcagctcaagcgccagtggtcgctgctcgaggaaaccgtcggcgcggcgctcgccgcatgcaagcgcgtgctgtcgcgccatcccgcgcgcgtcgtgctgccggccgacctgccgctcttgcagatggacgcggtgctgatggagcgcctgttcaccaacctgttcgagaacgcggcgaagtacacgccgcccgatacgccgctcgagatcggcgcggagcgcgtgaccgaagacgggctgccgttcgtgcgcgtgcatgtcgacgatcacggcccagcctgccggccggcatggaaacgcggatcttcgacaagttcacgcgcggcgagaaggagtcggcgacgccgggcatcgggctcggcctcgcgatctgccgcgcgatcgtcgaggcgcacggcggtaaaatcggcgcgctcaaccgcaccgcgcccgacggccacgtgacgggcgcgcgcttctggttcacgctgccggtcgagacgccgccggctgcgcctgccgtatccgacgacgaacccgaggtgccgggtgcgtcgtccccatccgagtcattgccagaccatgagtgaacccagcctgaccgtcgtcctgatcgaggacgaaaagcagatccgccgtttcgtgcgcgccgcgctcgaggaggaggacatcgcggtgttcgaggccgagacgggcaagcaggggctgatcgacgcggcgacgcgcaagcccgatctcgtgatcgtcgacctcggcctgcccgataccgacggcctcgacgtgatccgcgagctgcgcggctggtccgaggtgccggtgatcgtgctgtcggcgcgcacgcaggaagaagagaaggtcgcggcgctcgatgcgggcgccgacgattacctgaccaagccgttcggcgtgtccgaactgcgcgcgcggatccgcgcgcaactgcgccggcgcaaccagggcggcgcgaacgagtcgccgaaggtgagcttcggcaccgtgacggtcgatctcgcgctgcgccaggtgtggcgcgacggggagatcgtgcacctgacgccgctcgagtaccggttgctcgccacgctcgtgcgccacgcggggcgcgtgctcacgcaccggcagctgctgcgcgacgtgtggggccgtcgcacgtcgaaagccaccactacctgcgcatctacatggcgcacctgcgccagaagctcgagcgcgacccggcgcagcccgagtacatcgtcaccgagacgggcgtcggataccggctcgtcggcgccgcatgacgggcccggccgggccgcggcggcgcacgtgcgcgtgacgtcgcgcgccggcagggttgcgtcggcgcgacagtcccgcggccgacgcgcgcgttgcacacccggcgctcattccccgttatcctgaccgctccgcgaacgaaaacgaggagcgtgcaatgtccgtccgtctggtcgtcatctgtgcgctggcgcttgctgcgtctggcgcgttcgcccaaccgctgccgcccgggcagcaaccgccgtcgtcccagcaggcgacggccaatcccgcatcggtcaattgcaccaagctcggcggccaccacacggtacgcaacctgtcgagcgggcaggtcggcatgtgcgtgttcaaggacggccgcgtgtgcgaggagtgggcgctgtaccgcgacgaccgctgcgtcggcggcgcgacgccgaagcgcgtctcgaactgaccgggcccggccggtcgcgccccggccggccgccggcgtgtccgtaagcatcttgttatactcggcgccgcccgggacgacccgggacattcgcttcaacggggacggccccatccgatacggagtacgtcgggatggcgtgggtatggttgttgattgccggtttgctggaagtggcctgggcggccggcctgaaatcgtcggacggcttcacgaagctcggtccgtcggtgtttacgatcgtgacggcgctggccagcttcgggctgctcgcggtcgcgatgcgccagttgccgctcggcaccgcatacgcggtgtggacgggcatcggcgcggtcggcgcgttcgtgttcggcatcgtgatgatgggcgaggcgctgaccgccgcgcgcgtcgcgagtgccgcgctgatcgtcgcggggctgatcggcctcaagctgtcgtcggcggcctgacgaccgcatccgggtgcgccccgcccgggtgccgcgccgcggaattgcgccggccgcccgtctggcctgtctataatggaacgcattcgggcctgaataccgtcgtgcttctcgcggcacgcggtgccggtcgccacgcgccacgcggccggtctgtccgtcccgatccgatcaatcggcaaagcgcacggaaagtgcaaggagagggccatgatcgaagccatttcgctcggcgcggggctcgcgtgggcgagcggcctgcgcctgtacctgacggtgctgatcgccggcctgctggcgcggttcggctggctgcacctgcccgacacgctggccgtcctgatgtcgccgtgggtcatcggcgccgcggccgtgctcaccgtcaccgaattccttgccgacaagatccccgcgttcgactcgctgtgggatgccgtgcacaccttcatccgcattccggccggcgccgtgctcgcggccggcgcgctcggccatgccgatccgaccgtgcttgcggtcgcggggctcgccggcggttcgctcgccggtgccgcgcacgtggcgaaggccggcacgcgcgcgctgatcaacctgtctcccgaaccgatttcgaactgggtcgcatcgtcgaccgaggacggcctcgtggtcggcgggctcgtgctcgcgttcttcgttccgctcgccttcctggtgctgctcgccgcctttatcgcggcttccgcgtgggcgctcccgcgtctgtggcggggtgtctcgggcggctttcgcggcatggcgaaccacatggtgtcgcggctgaactcgatcgggggaagcgcgattgaaggggcggcaacacgcggcgcagccgcccgccgggcaacccggccatgagatgcgtgcgcatgccggccgcttcggcctgcgcgacctgatccgccaggctgcccgcatgaccgcgcgcgactggcgcgcgggcgagttgacgctgctcgtccttgcactggtactcgcggtcgcggcgctgacgagcgtcggcttcctcgccgaccggctgcgccaggggctcgagcgcgacgcgcgccagatgctcggcgccgatttcgtcgtgcgggccgaccgccccgtcgatccgtcgttcgaccggcaggcccgcgcgctcggcctgcgtaccgcgacgaccgcgatcttcccgagcatgatcgcgtccgccacgggcgggcaggcgtccgacgcggcgccgtcgcgcctcgcggccgtgaaggccgtgtcgcccggctatccgttgcgcggcgcggtcgagatcctgccggccggtgcctccgcctcgcagaaggcggccgggattcccgcgccgggcaccgtatgggccgatccggcgctgctcgatgcgctgcacctgaaggcgggcgatacggtgcgcgtcgggttgcgcacgttcaaggtcgccgcatcgatctcccgcgaactcgatcgcgggttttcgttcgtcaatttttcgccgcggctgatgatgcgcgcggacgaactcgccgcgaccgggctcacgggctacggcagccgggtcacgtaccggctgctggttgccggcgaccagcaggccgtcgcgcgcttcgaagcgtatgcgcacgcacgcgtcgacggcggaagctgcgcggtgccggtctcgagtcgctgcaggaaggccagccgcaggtgcggcagacgctggatcgcgcgcgccacttcctgacgctcgtcgcgctgctcaccgcgctgctcgcggcggtcgcgatcgcgatggccgcgcagcgctacatgcggcgccacctcgacggctgcgcgacgatgcgctgcctcggcgtgagccgccgcacgctcggcgcgttgttcgcgctcgaatttgccggcatcggcatcgtatccggcgccgcaggcgcggtgcttggctacggcggccactgggcgttgctggccgcgctcggcggactgatcgacgtggtgctgccgccgcccacgccgtggccggcgctgatcggcgtgggcgccgcgctcgtgctgctgctcggcttcgcgctgccgccgctcgtgccgctcacgcgcgtgccgccggtgcgcgtgctgcggcgcgagtggggcgacgcgtcgcgcaccgcgtgggccgcgtatgcgatcggcgtcgtgctgttcgcggggctgctgatcgtggccgccggcaacctgaagctcgggctgatcgtcgcgggcggtttcgccggcgcgctggtcggtttcgcgctgatcgcgcggctcgtgctgttcgccgccgcgcgggcggtgcgcaacgcgcgtgtggccgcgggcgtcggctggcgttacgcgctcgcgtcgctgcaccggcgcggcacggccagcgcgctgcagatcaccgcgctggcgctcggcctgatgtgcctgctgttgatcgcgatcacgcgcaacgacctcgttgcgggctggcggcagtcgacgccgcccgatgcgccgaaccagttcctgatcgacatccagcctgaccagcgtgccgacgtcgcggcgtatctggccgcgcacggcgtgcgcgacgcggtgcccgcaccgatggtgcgcggccgcctcgtcgcgatcaacggcaagccggtgaatccggatgcctacccgtccgacgaggcccgccggctcgtcgaccgcgagttcaacctgtcttatacgaccgagctgccgtccgacaaccggatcgtcgaaggcgactggttcggcaccgcggccacgccgcagatctcgatcgaggccggcctcgcgaagacgctgaacgtgaagccgggcgacgtgctgcgcttcgacgtgacggggctgacggtcgacgcgccgatcacgagcgtgcgcaagctcgactggggctcgttccgcgtcaatttcttcgtgctgatgccgccgccggtgctgaaggatttcccggccgtgtacctgacgagcttccatttgccggcctcggacgccgcgctgctcgatccgctgatcgcgcgctacccgaacctgaccgcgatcgacgtcgcgccgatcctcgcgcagttgcagcggatgatgctgcaggtggtcggtgcggtgcagttcctgttcgcgttcacgctcgcggccggtgtgctcgtgctctacacggcgctggccggcacgcgcgacgagcgggtgcgcgaggctgcgctgctgcgcgcgctcggcgcatcgcgggcgcaggtcaatgcggtgcagcgcgcggaattcatcgtggtcggcgcgctggccggcgcgctggcgtcggcgggtgcgatcgcggtcggctgggtgctcgcgtcgcgcgtgttcgacttccagctcgccgtcgatccgtggctcgtgccggccggcatcgcggccggcatcgtgtgcgccggtgcggccggctggctgagcctgcataatgtgctgcggcgccccgcgctgcagtcgctgcgcgacgcatgagcgtcgccggcggccccgaagatcccgttttccgactatccgtatgaccgatgtgaatgacgatgcgccgtcgcagccgacggcgttcgaactcgtgggcggtgaagcccgcgtgcgcgaaatggtggaccgcttttacgacctgatggacctcgagcccgagttcgcgcagattcgcgcgctgcacccggcgtcgctcgacggttcgcgcgacaagctgttctggttcctgtgcgggtggctcggcggccccgaccactacatcagccggttcggccatccgcggctgcgtgcgcggcacctgccgttcccgatcgcgtccgtcgagcgcgatcagtggctgcgctgcatggcgtgggcgatggaggatgtcggattgcccgaaccgctgcgcgagcggctcatgcattcgttctacgatacggccgactggatgcgcaaccggcccggttgaccgaccggtacgccgctgcacgcgcgcggggcgatctgcgtctgggcgcgcgcaccgcgtggcgcgacactggccgcttcccaatcgatacgaggtttgcccgatgacgacacaagcgctgtttcgcgaagacgcgtacctcacgcaatgcgacgcggtcgttctggccgtcggtgaagacggcatccggctcgaccgcaccgtgttctatccgctcggcggcggccaggccggcgacaccggcacgctgacgctgcccgacggcagcacgatcgcgatcgccgatacgcgcaaggcgaagttcgacggcgcgaccccgacgatgccgtgcacgtgcctgcaccggggcaggaggcgcgtgtcgcggcgctcgtgcccggcacgcgcgtcgccgcggagatcgactggctgcgccgctaccgccacatgcgcctgcatacggccgcgcacctgatgtgcgcggtgctgccgtacgcggtcgacggttgcagcgtgacggccgactatgtccgcctcgatttcgcgacgtccgacccgatcgaccgcgacgatgtcgagcggcgcctcgccggcctggtggtcggagcgcacccggtcacgaccgagtggatcaccgacgacgagatggccgggcggccggacctcgtgcgcacgatgagcgtgaagccgccgatgggcctcggccgggtgcggctgctgcgcatcgagcatgtcgacctgcagccgtgcggcggcacgcatgtgcgcaacacggccgaaatcggcgagctgcgaatcgcgaaactggaaaagaagagcgcgcgcacccggcgcctcgtcctggagtttgcatgacgatcgacaccacccacgcaggcgcggcgcttaatccgcatgcgcgggagatcctggatttctggttcggcgagccgggctcggccgaattcgggcaggcgcgcaaggtctggttcaacggcgggacggcgttcgacgacgtgctgcgcacacgctatggcgccttgctcgacgctgcgtgcgacggcggatgcgatcactgggcaggttcgccgtcgggtgcacttgcgttgatcgtcgtgctcgaccagttctcgcgcaacatccatcgcggtacgccgcgcgcgtttgccgccgacccgaaggcgctcgcgcttgcacgccgcgtggtcgcggccggctgggacgcgcagttgccgagcggacatcaccgcgcgtttgcgtatctgccgttcgagcacgacgagtcggtcgagagccagcgcgaggccgtgcgcctgtgcgcgggcatccgcgacgaggcgggctgcgaaagctatcaccgcttcgcgttgctgcatgcggccgtcgtcgagcgcttcggccgctttccgcaccggaacgcgattctcggacgcgagtcgagcgacgaggaaacggcgtttcttcgcgagcccggttcgtcgttctgaagattcgcgcagtcgcgcgataagggagggcagccccgcagccccgcggcgtcgcgcggccacccgcgtcagccgggcgcaccggtcggcggcgcgcgtttcccggcggctgttcgcgtgtcaggcggcggtgttcgccgttccccgcatggcatgaggggccgcacgacggtgcgccgcgcggccacccgtcactgcaggtgctgctcgggcgtgcgcacgtacacgcgcagcagttcgtcgttgtcgcccgggcgcgcgcccgaccagaacaatttccattcgctgcccggcgccggatcgacggcccgcacaccctggacgatcatccaggtgcagcgcgtcgttttcgcgtcgtcgatcggcgtgtgctggatgccggagaagtagtacagcatcggcgcttccgattcgccgagcccgtgcaggctcgccatgcagtcgccgtcgttccattcgagcgcgagatgcgcgttcaggtcgtcgaacaccgagcggtagctcttcgcgacgtcgagccacggcagaagcagcgtgtagatgagcccccatgcgacgagtgcgccggcgccccacgacagggcgccgcgccagaggcccgtcgcgcgcagtttcggcagcagcgtgagccagccgaccgtcagcacgagcgcgccggtcacgagcgcgggttcgatcggcatcgtccagtcgagcggcagccagcggccgagcggcgccagatccgcgcgcgacgcggccggatcggccatcaccgcccagattgcccaggcgagcgccacggccgtgccgaacaggatgcggctcaggtaatcccacgcgagatgcagccggcgcggcaggcgctcgatggcctgcgcggcgaccagcgcgagcggcgcgaagaacggcaggatgtagagctggcgcgacgtcgcggacacttgcagcacggcgagaccgatgccggtgaacaagacgggcagcgcgacgcgcggcgtccgccagtcgcgccacacgccgcgcgcgagcgcgacgatcgcgagcggcgcgaccgggaagccgacgagcaggaacgcgcggaggatgaagaacggcttgtcgttttccgcgcccagttcggggacggagaagccgaagaagcggccgacgttgttatcccagaaccacgtcatgaacagggtctcggagcgcatgaacagcgcggtcggccagatgagcgcgaacggcgcgaacacgagcgcggcgatgccgagcgcgcgcgcgaacgagcgggtgcggcaggccggatagagcaccagcgcgccgacgagcgaggccgcgaacacgagcggcacgaacagccccttcgccatcagcgcaatgccgacgcccgcgccgaagatcggtgcggcccagcggcccgacggccggaccggcagcccgtggcgcatctgctgcgcgcgcgcgacgtgctgcatcacgagttcgagcagcccgctaaagccgattgccgtgccggcgaacagcgcgacgtcggtcatcatgtcgtgcacgtgcttgatgacgacgagcgtgcccgcgctcaacacgacggggccgatcacgcgcaggtcgaaccaggtgtccgcgcggctggcgacgcgcgccgtgcgcgcgatgaagccgaacgcgagcgcggcgaacagcgcgctcgcgagtcgtgccgcgtcgtgcagcggcatcacgcgttgcagcagccatgcgaggctggttgcgacccacgcgtaaagcggcggcttttccatgaacggcaggccggcattggtcggcacgacgaagtcgcccgtctcgagcatgtgctggatgatgccgaacgtgtaggtttcgtcctgtttccagggatcgtgaccgaggacgcccggcagcacgtacgcgcagatcagcgcggcgacgaacagccatgcgcgccagtcgagcaggaacgagcgctcgtgcgtggtgctggttgcgacggtcgaggcggcgtcgggcgtgccggcgacgtcgagcgtcgcagtgaggtcggtgtcggcggtcgagcgggtgtgctgagccggggcgggcacagacgtgcgtcgccggccgggcgctgcggttccgggcatggaaaagatctcgggtcgagtcgagccggtccggcgacatgggcaggaccgattagggtcacatcaaggggtaacggacaggtgttgatgacgcctgtctgaatgcccgctagtagaccatggaattgttacgagagtttactgatagtgtcacgaaattgtggagatttgtggtgtcgtgacgactgatcctctcgggcggcggttttgctgcgccgcagtacggtattaccggccgccgccgacgtcgagcagggcacccgtcgtgtaggacgccgcgtcgccaagcagccagacgatcgcttcggcgatctcctgcgcttcgcccgcgcggccaagcggcgtcgttgcgccgaggcgggccgcacggcccggctggccgccgctcgcgtgaatttcggtctcgatcaggccggggcgtaccgcgttgacgcgcacgccgtgcgggccgagttccttcgcaagaccgatcgtcagcgaatcgaccgcgcccttcgagcccgcgtagtcgacgtattcgttcggcgagccgagccgggaggcgatcgacgatacgttgacgatcgcgccgccgcgaccgccacggtcggtggacagccggcgcgccgcttcgcgcgcgcacaggtacgcgccgagcacgttggtgtcgaacatccgccgcagccggtcggccggcatgtcggcgagcggcatcgacggcgcgacgatgcccgcgttgttgacgagcgcgtcgaagcgaccgaatgcggccgtgacggtgtcgaacatcgcgacgacgtcggcttcgttcgcgacgtcgcccgagacgacgcatgcacggccgcccgcgtcgcggacggcctgcgcggtgagttcggccgccgccgcgtcgcgcgcgtagttgatgccgacgtcccagccgcgcccggccgcgagcacggcggtcgcgcggccgatgccacggctcgcgccggtgatgaggacggccttgcggtcggacggtgcggtcatcgcgtgcaggttccggtggcgcttacttggctgcgtcgggcgcccacttgtcgcgggcgggcggctggtagcgacgcagtcgctcgatcaactcgacgggttcggattcgacgcacagcgcgtcgaaataggccggacgcatgaagccttcgtcgaccgtatggcgcagcagcgcgatcaacggatcgtagaacgaatcgatgttgtagaccgcgacgggcttgcggtgatagccgagctgcgcccacgtgtagacctcgaatagctcttcgagcgtgccggcgccgccgggcatcgcgacgaacgcgtcggagaggtcggccatcattttcttgcggtggtgcatgtcgggcacgacgtgcagttccgacagccccgtatggccgacttccttgtcgacgagcaattcggggatcacgccgaccgcacgaccgccggccgccatcacttcgtcggcgatcacgcccatcaggccgacgcggccgccgccgtagacgagcgtgaggcccgcatcgacgagcgcgcggccgaatgcgcgcgcggcgtcggcatagatgggccggacgccggacgacgagccgcagtaaacacagactgccttcattgcttggaatccttggcgggggcctgcccggtgacgacggggctgtctgccgggcgcggcgagccgtcgcgcggcggcaggtagtcggtgaactggcgcttcggcagcttgccggagaccaggtcgtcgaacaactggcgcgaacggccgcgcaggtacggtgccatcacggagatcacgtgcatgctgacctggtgcagttcctcgcggatcgcgtcctggtcgttgtacttgcgcggatgcatcacgtactgatacgacagccagtacgtcgaaatgacggccatgttggtggcgatgacctcgatctcggcgggtgtcgcgaccatctcggcgtcggatacgagcagctcgcacatgtcgcgcgcgaagcgcaccttgtggctgatgatctgcttgaagtgcgtctcgagcgtgcggttgcgcgcgagcaggtcgttgaggtcgcgatacaggaaccggtaggtccacatgaaatcggccatgtactgcaggtacgaccaggtttcgtcgatcgtcggacggtgatcttcgaaagcgcagccgccgttcgatctgctgctcgaactgcgcgaagatgctgttgatgatgtcgtccttgttgcggaaatggtagtacaggttgcctggactgatttccatttcctcggcgatcgtcgtggtcgtgacgttcggctcgccgatctcgttgaagagtttcaacgacaactcgagaatccgttcgcgggtgcggcgggaggtttcgcttccatgtcgtccggccctgtgtgtgccggactggcgggcgctgcaatcgatgctgcgtgattcgtccggcgcgggttgctgttctatgtctagcggacgattataaaccggggtttcgccacatcgggcgcatttcgtgtgcgcggccccgcacggcgcatggtgcagcgccgcacgcgggcggtgcgcggcgcgtgcgcccggcgctcgtctagaagcccagccagtgtgcgacgaccgggccgagcacgaaggcccacgtcgtcacgcacgcgaacagcgcgaccgtcacggccgcgctgccgaggtccttcgcacgcttggagagttcgtggcgttcgagcgagatgcggtcgatcgcggcctcgacgctcgagttcagcagctcgacgatcagcaccagcagcaccgacgcgatcagcagcgcgcgcgaggcggccggcaccggcgcaaacgcaccgatcgggagcatcagcgcggcgagcgtgagttcctggcgaaacgcgctctcctcgcggatcgcgacgcgaaagccgttcagcgaatgcttgagcgcgtaccaggcgcgcgtgatgccgcggtggcgcttgtacgggttcggcggcagcggcgtcagccgatcgtcggggccgagcggctcgtgcgcatgcacgtccgcatcggcatgcggctcttcctcgtcgaacggacggtgccgttgcggcgtggcgtcgggggcggggacttgtcgttcaggtctcgtttcaaacggcggcaccttctgctggcgagtacgcggtcttcggcagcggcttcagatgcgacgcgaactgctcggacgccgcgcgccacgaaaagcgttcggcccatgcgcgcgcagtcgcgcgttcgatcttcagcgcttcgaggcaggcttcctgcaggtcctcgtgcatcgcgccggcgtcgccttcgccgagcacgtcgatcgggcccgtcacgggataggcggcaaccggcgtgccgcaggcgagcgcctcgagcagcacgaggccgaacgtgtcggtgcgactcgggaacacgaacacgtcggccgcagcatacaccttcgcgagctcggcctgtgacaggacgccgagatagtttgcctccggataacgcgacttcagttccgcgagcgcggggccttcgccggcgacccatttcgagccgggcaggtcgaggcgcaggaacgcctcgacgttcttctcgatcgcgacgcggccgacatagaggaagatcggccgcgcggtattgagcaccttcgattccatcggccggaacacgtcgaggtcgacgccgcgggtccacagcacgacgttcgtgaagccgaatttctcgagatcctgcttgaccaccggcgtcggcgccatcaccgcgagcgacgggccatggaaccagtgcaggaagcggtaggtcgccgcgagcgggatgccgaagcgcgcctgcacgtactccggaaagcgcgtgtgatacgcggtcgtgtacggcagcttgcgcgaacgtgcatagcgccgcgcggcgaggccgagcgggccttcggtcgcgatgtgcaacgcgtcgggggcgaacgcgtcgatccgcgcgcgcagcttgcggtacggcaggatcgacaggcggatctcggggtaggtcgggcagggcaccgtgcggaattcgagcggcgtcagcagttcgacgcggtggccgagcgcggtgagttcgcgcgacgtgctcttcagcgtgcgcacgacgccgttgacctgcggttcccacgcgtcggtgacgatcatgatcttcatcgcggcaatgtcctgtaggtgcggggttgtgtcaggcagtggccttggccttgcgcgacgaggtttccgacggtgcggtgcgcatcaccgtccagtagacgatcttcagttcgccttccatcgtttcgacgagtgcggacaggctctcgacccagtcgccgtcgttgcagtacagcacgccgtcgatgtcgcggatctccgccttgtggatgtgcccgcacacgacgccgtcgcaaccgcggcggcgcgcctcgtcggtcatcacggtctcgaactgcgagatgaagttgacggcgttcttgacctggtgcttcaggtactgcgacagcgaccagtactggaagccgagccggctgcggatccggttgaaccagcggttcagcacgaggatcagcgtgtagagcgtgtcgccgaggtacgcgagccatttcgcgtgctggatcacgccgtcgaacaggtcgccgtgcacgatccacaaacgtttgcctgcgagcgtcgtgtggaacgcctcgccgcgcacctggatgtcgccgaacgcgaggtcgcagaactgccgcgcgccttcgtcgtggttgcccgggatgtagacgacctgcgtccccttgcgcgccttgcgcaggatcttctgcacgacgtcgttgtgcgcctgcggccagtaccagccctttttcagttgccagccgtcgatgatgtcgccgacgaggtacaggtactccgaatcgttgtggcgcaggaagtcgagcaggtacggcgcctggcagccgctcgagccgaggtggatgtcggacagccagatggtgcggtagcgatgcgcggacgagtcggggtcgtcatgccgcgtggcgtgaccggcaggcggttcttgcgacacccgcccgtcggttgcggcggaaccggacaggaaggcggtggcggcgcgggcgccgagagggtgacggaacagggaggtcgcagacgttttctggcccatgcatgactcgcgccggttgacattaccggcattccgccatgcgggcgtgactgtgccgtgacagtcacgagacgttcttattacgaccgctgcaaggtgtttagcagtgaatggcggggcgttgtgtggcctgccgtacggaacgtccggcgcttgtccggcaaggctgtcgggccgggcgggagtcgcctcggcgacgtgctttcgtctggagaatgcggtgcgtcagcgcttcaacgtgtcaacgcgggatggcgacgacgcgcgtgcgtgcgatccggtcgtgcggaaactggcggccggcatgcagccgggccgcgccggcccacacgacgatccacgcggcggtgagcgcgagcgtgacgggtaccgacaggccgaggagcggatgcagcgcgagcggcggcaggaaccacagccagccgagcgcatagcggacgagcgcgtggcccgcgctcagcggccggccgctcgacgattcgagccgcagccgccatgtcttcatcggcagcgtctggccgccgtgggtccagaaccagacgaagtacgcgccgaccacgagcgcgatccaggcggcgagcaggttgtgatggacgaggccgttgcgttgctgcgtcgcgaggctgaacgcgagtccggcgaagaacaccacaccgaacagcagcacgccttcgtagagcagcgcggcgagacgccgccgcacggacggcgcggcggccggggtttcggggcgcgggcgttcgccacggccgctcaggagcccttgaacagcgagggcgcgtcggcgggtgacaccggcgccacggcggccggcgcggacgcggtgccggccgtcgacgacgcgggcaccggctgcgcggcggcggccgagacgggcgccggcgcggtggctgcgccgcttgcggcgtgatcgtgcgaattgacgaggcgacggacgtcacggtcggcgacggtcggcggtgcgctgacgacgctcggccggcggcggcgctcggcggccgcgagacgttccttctgctcctcgggagttgctggtacgccttccaggcccgctcgcgtgcctgcgcggacagctccttcgcactctggtagttctcgcgcgcgacgcggcgctgctcgggcgtcatccgcgcccattcggtcatccggtcctgcaggcgcttttgatcatcgggcgtcaacttcgcgaaacgcgacgcgatcttcagccatttgcgcttgcgtgcgtcgctgaagccatcccactggtcggcgaacggcgcgagtgccgcgtgttgcgccggcgtgaggcgcgcccaggacagcgggccggacgcggccggcagcggcaggggcagcgggggcagttcggtggtcagcccggtcgcggccgatgcgggcgcggcagggctgttggccgcggcggtgggcgtcgcgggggccgggtggaatcgtgggtacgtggcgacgtaggaaacggcgatcgcgattacgcatccgaaaaatacggccaggccgcgcttctgactcacccgtgcgatcccctcgttattgtctgttagtgcgcacgcgacagatacgcgttgaacccgtgatcgagatacgcgttgagcggcaggtcgtcgctgagcatcgccgcgtcgatgtcggcgagttcggcggtgcgctgcatgtcttcccagtaggcgatgccgacgagccccgcgagcagcagcgccagcggccacgcgcgcagcaggcggcgcgcgaacgacgcgtacgggcggccggcctgcgggcggcccgcgggcgccgtgccgtacgcaccggccgcgccggcgaaggccggcacgaacaccggcacggtcgcggcttcgggcttcttgcgcgcgagcgcagcccggcgggcggcggccagacggtcggtggtcgcggcaggcaggtcggccgcgcgctcgtccagcgcgcggcgcaccttcagcgcgaattcgtgttctcgatttgcgggagcggagctcatagcgtgattcctttggccttgagcgcttgcgccagggtgtgggtggctcgcgagcagtgcgtcttgacgctgccctcggagcaccccattgcggcggcagtctcggcgacatccatatcttcccaataacgcatcaggaacgcttcccgttgacgcgtcggaagtttctggatttcttcgtcgatcagggccagaacctgctctcgttcgaggcggtgctcgctgctttcgacgcccgcgttgtcgtccgcggattcgagggtttcgagcgggtcgaaatcgtcgtcgtcggtgttgttcagcgacgagaacagcgtgacccacgtgttgcggaccttctgccggcggaaccagtcgtggatcgcgttctgcaggatccgctgaaaaagcagcggcagctcggccgccggccggtcgccgtacttctccgcaagcttgatcatcgcgtcctgcacgatgtcgagcgacgcatcgtcgtcacgcacggcgtacgcggcctgcttgaacgcgcgcctttcgacgcccgccagaaagtcggcgagttccttgtctgatgccattccgtgaaggtatgcgctgcgggccgctgcgtggtgaaaaaggtcgaaaaatttcgtaaaacccgcggatgctatcaaattttcgtgccgcttggcaccggggcgggcgccgcacgttgcgcgcgagccgcggcggcgggtgccgggcggggcccatgatgcgctgcgggatattttgcttgacgacccattcgcgacccgctatcgtcaacgattcgcaacatgaagtgatggtctcatttgaggctggcccaagaagcctgcccttcaaactggacgcgccgcttgaacccgagccacaagcccggcagagagcacccgatcaatttttgccgaaaattcgaaaggtcaaaatgaacatgcccagcgcggaattctccacgtcggaacccctttcctcccgatagcgactccatcggcggcaccgtgctcatgaaggcactggccgatgaaaacgtcgaattcatctggggctaccccggcggctcggtactctacatctacgacgagctttacaagcaggacaagattcagcacgtgctggtgcgccacgaacaggcggccgtgcacgcagccgatgcgtatgcgcgttccaccggcaatgtcggcgtctgcctcgtgacgtcgggccccggtgtcaccaacgcggtgaccggcatcgcaacggcgtacatggattcgatcccgatggtcgtgatcagcggccaggtgcccacggccgcgatcggccaggacgctttccaggagtgcgacaccgtcggcatcacgcgtccgtgcgtgaagcacaacttcctcgtgaaggacgtgcgcgacctcgcggaaaccgtcaagaaggcgttctacatcgctcgcaccggccgtccgggccccgtgctgatcgacatcccgaaggacatctcgaagacgccgtgccagtacgagccggtcaagagcgtgtcgctgcgttcgtacaaccccgtcacgaagggccattcgggccagatccgcaaggccgtgtcgctgctgctgacggcgaagcgtccgtacatctacacgggcggcggcatcatcctcgccgacgcgtcgcgtgaactgaaccagttcgcggacctgctcggctacccggtcacgaacacgctgatgggcctcggcggctatcgcgcgtcggacaagaaattcctcggcatgctcggcatgcacggcacctacgaagcgaacatggcgatgcagcactgcgacgtgctgatcgcgatcggtgcccgcttcgacgaccgcgtgatcggcgatccggcgcacttcgcgtcgcgtccgcgcaagatcatccacatcgacatcgacccgtcgtcgatctcgaagcgcgtgaaggtcgacatcccgatcgtcggcgacgtgaaggaggtgctgaaggagctgatcgagcagttgcagacggccgagcatggccccgacaccgaagccctcgcgcaatggtggaaggacatcgagggctggcgcgcgaaggactgcctgaagtatgaccgcgaaagcgagatcatcaagccgcagtacgtggtcgagaaggcgtgggagctgacggacggcaatgcgttcgtgtgctcggacgtcggccagcaccagatgtgggcggcgcagttctaccgtttcaacaagccgcgtcgctggatcaactccggcggcctcggcacgatgggcttcggcctgccggcagcgatgggcgtcaagatggcgcacccggacgacgacgtgctgtgcatcacgggcgaaggctcgatccagatgtgcattcaggagttgtcgacctgcctgcagtacgacacgcccgtgaagatcatttcgctgaacaaccgctatctcggcatggttcgccagtggcagcagatcgaatacagcaagcgctattcgcattcgtacatggatgcgctgcctgacttcgtgaagctcgccgaagcgtacggccatgtcggcatgcggatcgaaaagacttcggatgtggagccggcgctgaaggaagcgctgcgcctgaaggaccgcaccgtgtttctcgacttccagaccgatccgaccgaaaacgtctggccgatggtacaggccggcaagggcatcaccgagatgctgctcggatcggaagacctgtaacggcgcgacgcgcgcctgggccgaagcggccgccttcacgaagggcggtgcggcacgcggcggcgcgcggcgcgagtgaatcgacacggacacattctggaagaagcgaacatgagacacatcatttccgtcctgctggagaacgaaccgggcgcgctgtcgcgcgtggtcggtctgttttccgcacgcggctacaacatcgaaaccttgacggtggcgccgaccgaagaccaatcgctgtcgcggctcaccatcgtttccattggctccgacgacgtgatcgaacagatcacgaagcatctgaaccgcctgatcgaggtggtgaaagtggtggacctgaccgacggtgcacacatcgaacgcgagctgatgctgatcaaggtacgtgcagtgggcaaggagcgcgaagaaatgaagcggatggcggacattttccgcggccgcatcatcgacgtgaccgaaaagacctacacgatcgaattgacgggcgcgagcgacaagctcgacgcattcatccaggggctggacgcgggcgcgatcctcgagaccgtgcgcaccggcagctccggcatcggacgcggcgagcgcatcctgaaggtgtgatgccgacattgccaaagtggcacgccgggtgcgccgtcatgtcccggcccgcagtactccatccgaacgaattgttgaatttttgaattagcgaaggaaccatcatgaacgttttctacgacaaagacgctgacctctccctcatcaagggcaagcaagtcacgatcatcggctacggctcgcaaggccatgcacacgcgctgaacctgaaggacagcggtgtcaacgtgacggtcggcctgcgcaagggcggcgcgtcgtggagcaaggccgagaacgccggcctgtcggtcaaggaagtcgcggaagcggtgaagggcgccgacgtcgtgatgatgctgctgccggacgagcagatcgccgacgtgtacgcgaaggaagtgcacgagaacatcaagcagggctcggcgctggcattcgcgcacggcttcaacgtccactacggcgcggtgatcccgcgcgccgacctcgacgtgatcatgatcgcgccgaaggcaccgggccacaccgtgcgcggcacgtactcgcaaggtggcggcgtgccgcacctgatcgcggttgcgcagaacaagtcgggcgcggcacgcgacatcgcgctgtcgtacgctgcggcgaacggcggcggccgtgccggcatcatcgagacgaacttccgtgaagaaaccgaaaccgacctgttcggcgagcaggccgtgctgtgcggcggtaccgtcgagctgatcaaggctggtttcgaaacgctggtcgaggcaggttacgcgccggaaatggcgtacttcgagtgcctgcacgaactgaagctgatcgtcgacctgatctacgaaggcggcatcgcgaacatgaactactcgatctcgaacaacgccgagtacggcgagtacgtgacgggcccgcgcatcgtcacggaagagacgaagaaggcgatgaagcagtgcctgaccgacatccagacgggcgagtacgcgaagagcttcatcctcgagaacaaggcaggcgcaccgacgctgcagtcgcgccgtcgcctgacggccgagcaccagatcgagcaggtcggtgcgaagctgcgcgcgatgatgccgtggatcgcgaagaacaagctcgtcgaccagacgaagaactaagcaccgcgtgctgttccggcccctcgaatagagggccggtaaaaagccgcccgaaggcagcagtgccccgggcggcttttgttatgctacgggctttgcaattcaccgaacacagaacgaatccatgaactatcctcatccgatcatcgcgcgcgaaggctggccgttcatcgcgattgctgccgtcatcgcgctgttgatccacgccgtcgggggcttcggcttcgcgtggccgttctggctgctgctcgtcttcgtcgtccagttcttccgtgatccgcagcgcccgatcccggcgcagccgaacgcggtgctgtgcccggcagacggccgcatcgtcgcggtcgagaccgcgcaggatccgtacgcgaaccgcgaagcgctgaagatcagcgtgttcatgaatgtcttcaacgtccattcgcagcgttcgccggtcgatggcgcgatctccaaggtcgagtacttcccgggtgcgttcctgaacgcggcgatcgacaaggcgtccaccgagaacgagcgtaacgcggtcgtgatccagacggcgagcggcaagaccgtgaccgccgtgcagatcgccggcctcgtcgcacgccggattctctgctacgtgcgcgccggcgagccgctgtcgcgcggccagcgctacggtttcatccgcttcggttcgcgcgtcgacgtgtacctgccgctcggcagccgcgcgaaggtgtcgatcggcgagaaggtctacgcgtcgtcgacgatcctcgccgagctcgaacagtaagcggcggggcgcacgatggccgcattcaaaccgcgtcggccgcgcaacggcgccggccagacgccacgcccgttccgccgcaacaaggggatggccgccgatccggtgccgatcgagagccgccgcgccgcgcgccagcggttcctgaagacgcgcggcatctacctgctgccgaacgcgttcacgaccgccgcgctgttctgcggcttcttcgcggtcgtgcaggcgatgaacgtgcgcttcgagatcgccgcaatcgcgattttcgtggcgatggtgctcgacgggatggacgggcgcgtcgcgcgcatgacgcatacgcagagcgcgttcggcgagcagttcgacagcctgtcggacatggtgtcgttcggtgtcgcgcccgcgctcgtgatgtacgagtgggtgctgaaggatctcggccgctggggctggcttgccgcgttcgtctactgctcgggcgccgcgctgcgcctcgcgcgcttcaacacgaacatcggcgtcgtcgacaagcgtttcttccaggggctgccgagcccggccgccgccgcgctgatcgcgggcttcgtgtggctcgccaccgacaaccgcgtgccgatgaagctcggctggctgccgtgggtcgctttcgtgctgacgatctatgcgggcgtgacgatggtgtcgaacgcgccgttctacagcggcaaggcgctcgacgtgcggcaccgcgtgccgttcgcggcgatcctgctggtcgtcgtcgcgttcgtgctcgtgtcgtccgacccgccgctgatgctgttctgcctgttcgtgctgtacgggctgtccggctacgtgttctgggcctacatggccgtgcgcgggcgggcaaaccccgcgcgctcgtcgcagcgcgatcactgacacgcgttgtttaccggaaacggcggcctcggggccgccgttttcatttgtcccctgttcggcccggactgccggaaaccccgggtgccgtccgattgcgcacccaacggaatgccgctatagtctttggcatgactgcattttcccgcctctccctccttctagccggtgcgccgctacgcgcgctagcttcggcgcgcctgccgcgctgaccgttcccgccctccgtcaagcttcgtctgttgttgagcgtcgccaacggtggcgcgatctcgttacgtttgacttccgtataaagagccctggagcccccatgacagacaagctgatcattttcgatacgacgttgcgtgacggcgaacaatcgccgggcgcgtcgatgacgaaggaagagaaaatccgcatcgcgaagcatctcgagcggatgaaggtcgacgtgatcgaggccggcttcgcggccagctcgaacggcgatttcgacgcgatccacacgatcgccggtctcgtgaaggacagcacgatctgctcgctcgcgcgggccaacgacaaggacatccagcgtgcggccgacgcgctgaagccggccaacagctcgcggatccacacgttcatcgcgacgtcgccgctgcacatggagaagaagctgcgcatgacgccggaccaggtgttcgagcaggcgcgtctcgcggtgcgctttgcacgcaagttcaccgataacgtcgaattctcgccggaagacggcagccgttcggacctcgacttcctgtgccgcgtgctggaagccgtgatcgccgaaggggcgacgaccatcaacatcgccgacacggtcggctacggcgtgcccgagctctacggcaacctcgtgaagacgctgcgcgaacgcattccgaactcggacaaggcgatcttctccgtgcattgccacaacgacctcgggatggcggtggcgaactcgctcgccggcgtgaagatcggcggcgcgcgccagatcgagtgcacgatcaacggtctcggcgagcgcgcgggcaacacgtcgctcgaggaaatcgtgatggcggtgaagacccgcaaggactacttcggcctcgacgtcggcatcgacacgacgcagatcgtgccgacgtcgaagctcgtgtcgcagatcaccggtttcgtcgtgcagccgaacaaggcggtggtcggcgcgaatgcgttcgcgcacgcatcgggcatccaccaggacggcgtgctgaaggcgcgcgacacctacgagatcatgcgcgcggaagacgtgggctggaccgcgaacaagatcgtgctcggcaagctgtcgggccgtaacgcattcaagcagcgcctgcaggagcttggcgtgtcgctcgacagcgaaagcgaactgaacgcggcgttcatgcgcttcaaggatctggctgatcgcaaggccgagatcttcgacgaggacatcatcgcgatcgtgtccgaggaatcggcgctcgcacacgagcaggaacacttcaagttcgtgtcgctgtcgcagcactcggaaacgggcgagcaaccgcacgcgaaggtggtgttcggggtcgacggtaaggaagtgaccggcgaggcgcgcggcaacggcccggtcgacgcgacgttcaatgcgatcgagagcgaagtcggcagtggttccgagctgctgctgtattcggtgaacgcgatcacgaccggtacgcaggcgcagggtgaagtgactgtccggctgtcgaagagcgggcggatcgtcaacggcgtcggcaccgatccggacatcgtcgccgcatccgcgaaggcgtacatctccgcgctgaacaagctgcattcgaaggacgacaaggtcaatccgcagcgctcgtaagcgccgcgcgtcgcgcatcaccgaaacgccccgtgcggccctgcgccgccggggcgtttttcatgcgccgctcattcggcggccggcgcacggaacagccagcggcgcgcggccgtgcgcggtaccgggctgcggcgccggaactcgacggcgatgccacgtcgcggcgcatcggcgacgaacgcgtcgagtagttcgagcacgtcgtgatcgatgtaatcggcgcgtgtcgcgtcgatgatcaccgcggcccggtcgggaatgtgccgcaggtgatgcttgacctgcaccttgccgagaaacgacacgtccttgcggaacgacagcaggaagtggtcgtcgtgctgcgcgagcgtcacggggcttttcaggttcgcgacggcgacggccagcacgctgcacgcgaggccgagcgcgatgccgaacagcaggtcgaccgcgagcacgccggcgatcgtcgcggcgaacggcacgaaggcggccggcccctgtttcatcaccgagcggaacagcgccggtttcgccagcttgaagccggtatggatcaggatcgcggccaggctcgcgagcgggatcaggttgatcaggccggtgagcgcgaacacgctcgcgagcagcagcatcccgtgcacgatcgccgacatccggctttgcgcgcccgcgttgacgttcaccgaactgcgcacgatcaccgacgtgatcggcaacccgccgactgcgcccgcgacgagattgccgacgccctgggccttgagttcgcgatcgggctgggtcggccggcgcttcgggtcgatctgctcgacggcttcgaggctcagcagcgtctcgaggctcgcaacgaccgcgagcgtgatcgcgacgcgccacacgtccggattgacgagctgcgcgaagttcgggccgagctccgcatgcttgagcgacgccgcaaaggccgcgaacgagccgagttcgggcagcgtcacgcgatgggcggcgcccggcgcgaccgacggtgcgacgatgctcagcacgagcgtggcgccgatacccagcacgacgaccgcaagcggagccggcaccgagcgcaccagcgcgaagcggcgcagcgcggacgtgtcccacgcgatcagcaacgcgagcgacgcaagcgcgatggccgtggcggcccacgcgaccggcaggccgggccagttcgcaaacgattgcgcggccgacccgccgataccgaacgcgaacggaatctgtttcacgatcagcagcaggccgatcgcggcgagcatgcccttgatgacgggtgacggtacgtaggcggcgaagcggccggcgcgcagcatgccgaacccgaactgcaggacgccggacagcagcaccgcgagcaggaatgcggagaagctgccgagttgtgcgatgccttcgacgacgatcacgacgaggccggcggccggcccgctgacggacagcgacgagccgctcagcagcgcgacgacgatgccgccgacgatgccggatacgagcccggcaaacggctcgacgccggatgcattggcgatgccgagacacagcggcagcgcgacgaggaacacgacgacgccggcgacgatgtcgcgcggcagggtggacaggcgctggttcagtttcatggtcgggatgatttcattggcttttggggcaggtcagccgagcgcgcaggccgcgacggcctgcacgggttcgacgtcggcgggcggggtggtgtagccggaatcgagttccttcaggcggccgtccgcgagcgaaaagatccagccgtgcacgagcggtggccgttcgcggccccgcacgatcggggacgcacgcagcagccgcacctgctcgagcacgtttagctcggcgaggcggtcggcggcggccgtgtcgtcgagcccgtccagcgtgtcacgatggcgtcgcgcgagcgcgcacagcggcgcgatgcggcgtgcgacgtgcggcaggtcggacggcggcggcagcagcgatgcgcgtacgccgccgcacccgtagtgcccgcacacgatcacgtggtcgacctgcagcacgcgcaccgcgtactcgagcacgctggcggaattgtcgtcgtcgggatggaacaggttcgcgatgttgcgatggacgaacagctcgccgggcgcgcagtgcgtgatggtttcggccggcacgcggctgtcggcgcagccgatccacagcacgcgcgggttctggccgcgcgcgagtgcgtcgaagaagccgggcgtgtgttcacgcgtttcgcgggcccaggcgatgttggcaaccagcatgctcttggggcgattcatgaggactcctttgagataaaggcaatcgaatatcggcaaaaatgacgaaatggcattctttctaaattgaaaggttgagtttcgactgatattagggtatgccctagcgcttcggggtgttgaaacaaattgtttcaaattggtttggcgtagtgcattgcatgcaccaactcaccgcatgatatgcactgcgcgtgcctgttttcaggcaaaggcccgtatgacggggatgtcagcgaattgccatcggcctgtcatcgatcggaaaagatttccgtcgcatttgccgaattaataagccggcggaaaaatgaaatggccattcacgcaatgattcgtgaatggccatcgagataattgcgcgtaaatgcgtaatcggtcagaacaggttgcggcggtcggggtcgtgcaacgggtcgggtgttttctgcgtgatgcgcaggatgccctgcgggtcgaagtagaagctgtacatcatgtaccagacgttgtcctcgagataccggtacgtccatacctcgcgcttcatcagcgggaagtaggacgtctcgacggggcgtccgaagttgacgaggacgtcggtcttcgtccacttgccgatctccgcacgatagaactcgctcggctgcaggacctggcgcacgttgatgatcttgtgggccgcatcgacgtcggccgcgacggtgatctcgcccatcggctgggttggccacatcaggcgcttgccgccgccgggcaggtcgtagatctcgcgcggcgggcccatgcgtgcgacgatcgccgactcgtcctggccggcctggtattgctgccacggttgcgcgcaaccggtcagcagcgcggcggcgctggcgagcagcaccggcaggcgcgcggaaatgcgaatgcgcatggggattctccagaacacggaaacaagtcccgttttatcacggacggcgagcgatcgcgcatcgcttggaaaaacggtgcggatcgccggcacggtcacgcttgcgggcggcggggcgccggcctatgatccgcgcttctcgggctgattgaagggcaggtggccgatgcaggggtggaagcggtgcgcgctcgcgttgagcgcggggtggatgctggtgtcgtccgcatttgccggcggcgagccggtgcggatcgcgctgatcgaagggatgtcgggcccgttcgcgaacgcgggcgcggcggtcgagcgcaacctgcgcttcggcgtcgagcaggtgaacgcggcgggcggggtgaagctgcgcgacggcacgcacccgctcgaactcgtcgtgctcgacagcaagggcagccccgaggaggcgctcgtgcagctgcgcgcggccgcggatcgccacatcggcttcgtcacgcagggcaacagctcggccgtcgcggccgcgctcgtcgcggcgctcgacaagctgaacgcgcgcgatccggacaaccggatgctgttcctcaactattcggccgacgatccggcgctgaccggcgcgcgctgcagtttctggcatttccgcttcgatgcgcacgccggcatgcggatggccgcactcgcggacgtgatggcacgcgaccgcgcgctgcgcaaggtctacctgctgaaccaggactacagtttcggccacgacgtcagcacgctcgcacggcaggcgctggccgcgcggcgcccggacgtgacgatcgccggcgacgagttccacccgatcggccggatcaaggatttctcgccgtatatcgcgaagatccgcgcgagcggcgccgacgccgttgtgaccggcaactggggcaacgacctcacgctgctcgtgaaggcggcgcgggagcaagggctgaatgcgaagttctacacgttctacggcaacagcctcggcgcgccggcagccctcggcgacgccggtgtcgggcgggtcgtcgccgtggcggactggcacccgaacgcaggcggtgcgaaatcggacgcgttctaccgggcgttccggaaccgttttccagccgcccaggacgactatccggtgcggcggatgagcctgatgatcgagatgctggccgccgcgatgaaccgtgcgggttcggccgaccctgtcgcggtcgcgcgtgcgctcgagggtctgtcgttcgacgacggcttccatgcgtcgcggatgcgcgcgcaggaccatcagttgatccagcccctttacgtgatggagatggacaaggccggcacgccgggcgtgcgcttcgacaacgagggtcgggctatggcttccggacggtgctcgcggtgccggcgcagcgtaccgaaatgccgtccgcctgctcgatgacacgcccgtgacagggggcggtaagaacggcgtggagttgtgctacaatgcccgccggttgtaagtcacggcacggccattcttccgtgtccgcctgttcagttagaaagtagaaaccaaggaaatctcatgtctgttgcagatatcaagaagtcggaagtcgttgctcagttcgcccgcggtacgaacgacacggggtcgcccgaagtccaggtcgcactgctgaccgcacgtatcgtcgaactgacgggtcacttcaagacccacgcgaaggatcaccacagccgccgcggcctgctgcgcatggtgagccgccgccgcaagctgctcgactacctcaagggcaaggatgccgaccgttaccgcgcactgatcgagaagctgggtctgcgtaagtaatcgaggcgattgccgccagcaagatgcctgtgtcagtccgctgatacaggcattttgtttttgcgcgttgcgtagcgtcacacgcatcgcaggctgtccggcacgaccgtgcggggccgccgcaacgactgataccggggcaggatttgtgtcattccagcgcgtcgctgcacgagtgccgcgctggaatggcataaaaacacaccttgctccgggtgattcggtcgggacgccgccgcgcgggatggccggcgcggcgaatgaaatgcatgaattcaaaggagcaaccatgtccatgttcaacaaggtcgtgaaggaattccagtggggccagcacaaggtgcgcctcgaaaccggtgaagtcgctcgccaggcaagcggcgccgtgatcgtcgacgtcgaagacaccgtcgtgctggcaaccgtcgtcggcgcgaagtcggcgaagccgggccaggacttcttcccgctgaccgtcgattacctcgagaagacctactcggccggcaagatcccgggtggcttcttccgtcgcgaaggccgtccgtcggagcacgagacgctgacgtcgcgcctgatcgaccgtccgctgcgcccgctgttcccggaaggcttctacaacgaagtccaggtcgtgatccacgtgctgtccgtgaacccggaaatcccggcggacatccccgcgctgatcggcgcatcggctgcgctcgccgtgtcgggcctgccgttcaacggcccggtcggtgccgcgcgcgttgcctacatcgacaacgcctacgtgctgaacccgacgcgtgaccagatcaaggcatcgagcctcgacctcgtcgtcgcgggtacggagcgtgcggtgctgatggtcgaatcggaagccgaccagctgtcggaagacgtgatgctgggcgccgtggtgttcggccacgagcagatgcaagtcgcgatcgacgcgatccacgaactggtgcgcgaaggcggcaagcccgagtgggactggcagccggcgccgaagaacgaggcgctgatcgcacgcgtgaccgagctggcacagaacgacctgctcgccgcttaccagctgcgcgacaagcaagcgcgttcgacgaagctgaaggaagtttacgcagcgacctcggcgaagctcgaggaagacgcactggcagccggtacggcagcggccgacaaggccaccgtcggcaacgtgctgttcgacatcgaagcgaagatcgtccgttcgcagatcctgaacggcgagccgcgtatcgacggccgcgacacgcgcaccgtgcgcccgatcgagatccgtaccggcgtgctgccgcgtacccacggctcggcgctgttcacgcgcggcgaaacgcaggcgctggtcgtcgcgacgctcggcacgaagggtgacgagcagatcatcgacgcgctcgaaggcgaataccgcgagcgcttcatgctccactacaacatgcccccgttcgcgaccggcgaaacgggccgcgtcggctcgccgaagcgtcgcgaaatcggccacggccgcctcgcgaagcgcgcgctggtcaagtgcctgccgagcgccgacgaattcggctactcgatccgcgtcgtgtcggaaatcaccgaatcgaacggttcgtcgtcgatggcatcggtgtgcggcggctgcctcgcgctgatggacgccggcgtgccgatgaaggcgcacgtcgcgggtatcgcgatgggcctgatcctcgaaggcaacaagttcgcggtgctgaccgacatcctcggcgacgaagatcacctcggcgacatggacttcaaggtcgcgggcaccgagcagggcgtgaccgcgctgcagatggacatcaagatccagggcatcacgaaggaaatcatgcaggtcgcgctcgcgcaggcgaaggaaggccgcatgcacatcctcggcaagatgacgtcggcggtttcgggtgcgaacacgcaactgtcggaattcgcgccgcgcatgatcacgatcaagatcaacccggaaaagatccgcgacgtgatcggcaagggcggttcggtgatccgcgcgctgacggaagaaacgggcacgaccatcgacatctcggacgacggcgtcgtgacgatcgcgagcacgaacagcgacggcatggccgaagcgaagaagcgcatcgagcaaatcacggccgagatcgaagtcggccaggtgtacgaaggcacggttctgaagctgctcgatttcggcgcgatcgtgaacctgctgccgggcaaggatggcctgctgcacatctcggaaatcgtcaacgagcgtgtgaaggacatcaacgactacctgaaggagggccagcaagtgaaggtcaaggtcatccagacggacgaaaagggtcgcgtgcgcctgtcggcgaaggcgctgctgaatgaagcagcggcagctgcgcagtcggatacgccgccgcagcagtaagcgggcaggcagacgaacggccggcagtgcgaaagcgtgccggccgtttttctgtagcatcgttgtgcggcgcagcagcgccggcaacgcgtccgtgccgcgtgcgggcgcaccatccgattccgatcctgatcccggagcgaccatcaccatgaaagccatcgaaatcaccgaattcggcgcccccgacgtgctgaagctcgcggagcgcccgcgccccgaaccgaagcgcggcgaagtgctgatcaaggtggcggcttccggcgtgaaccggcccgacgtgtttcagcgcaagggcgcgtatgcgccgccgccgggcgcgtcggatctgccgggcctcgaggtcgcgggtgagatcgtcggcggcgacctgtccgacgcggcgctgaacccgttcggcctgaagctgggcgatcgtgtgtgtgctgctcgcgggcggcggttatgccgagtatgcggtcgcgccgctgctgcaatgcctgccggtacccgacgggcttacggatatcgaggccgcgtcgctgcccgaaacgttcttcaccgtatggagcaacgtgttcgaccgtgcgcagctcggtgcgggcgagggcggcgagcaggagacgctgctcgtgcagggcggctcgagcggcatcggcgtgacggcgatccagatcgcgcatgcgcttggttttcgcgtgttcgcgacggccggtactgccgacaagtgccgcgcgtgcgaggcgctcggcgccgaacgcgcgatcaactacaagacggaagacttcgtcgaggtcgtgaagtcgctgacgcacgatcgcggcgtcgacgtgatcctcgacatggtggcgggctcgtacgtgccgcgcgaactgtccgcactcgcggatggcggccgtctcgtgctgatcgcgctgctcggcggcgcgaaggccgacgtcaacctcggcgagatcctgcgtcgccggctgacgatcacgggttcgacgctgcgcccgcgtccggtcgagttcaaggcgcagatcgccgcgcaactgaaggcgcgcgtgtggccgctgattgccgatggccgtatcaagccggtgatctatcgtgtattgccggccgcggatgccgcgcaggcgcatgcgctgatggaaagcagcgagcacaccggcaagatcgtcctggattggggtcgaacgcctgacggcccgtgtggccgggcttgacatgcgcggtttgaccggttcaagccgtgcgcagtaaaatcgcgggtttgcttcgccagatcaaacctgacggccggtttccggcacgttaatgaccaagcggtgacgagacagacacgatgtcgaaacagagaactaagcgtgtgatcggcaactggaagatgcacggccggctggccggcaaccaggcgttgctgaacgaagtggtgcagggtgcgggcgcggtggcggccgaaacatcggtcggcgtgtgcgtgccgttcccgtatctcgcgcaggttcaggcgcagctcgacggcggccgtgtggcctggggtgcgcaggacgtgtcggcgcacgaacagggcgcgttcaccggcgaagtggcggccgcgatggtcgcggagttcggcgcacgctatgcgatcgtcggtcattcggagcgtcgcgcgtatcacggcgagcgcaacgagacggtcgcggcgaagacgcagcgcgcgctcgcggtggggctcacgccggtcgtgtgtgtcggcgagacgctcgacgagcgcgagtcgggtgcgaccgagcaggtggtcggtgcgcagctcgacgcagtgctggccgtgctgacggccgacgaggctgcgcgcatcgtcgtcgcgtacgagccggtctgggcgatcggcacgggcaagagcgcgacgtcggtgcaggcacaggacgtgcatgcgttcctgcgtgggcgtctcgcggcaaagggtgcggcggacgtgtccgtgctgtacggcggcagcgtgaagccggacaacgcggaagagctgttcgcgcagccggacatcgacggtggcctgatcggcggcgcgtcgctgaaggcggaagattttctggcgatctgccgggccgcgcgataagcggtccgggatcgaattgaaccatgagggcggccggtcgttccggtcgcccgatccaatcgggtgggtgtgatgctgttattcaagacgctgattattgtggtgcaggtgctgtctgcactcggtgtgattggtctcgtgctgctgcagcacggcaagggtgccgacatgggtgctgcgttcggcagcggcgcgtcgggcagcctgttcggtgccacggggtcggcaaacttcctgtcgcgtacgacgggcattctcgcgacgatcttcttcgttgcgacgctggcgctgacgtatctcggttcgtacaagtcgacgccgtcggccggtgtgctcggcacggcagcgaccgcgccggcatcggcacctgcagcatcggcgccggtagtcgcggcatccgccgccgttgcgggttcggctgcgagcgcgccgggccaggatgtcccgaaataaaaagttaaaatttttgcgattgtgcgttgaacaattccgggactcaggttagaatttaattcttgaagcgattcgcgggaaacaagtagttacaaccccggttgcatgcagtgccgacgtggtgaaattggtagacacgctatcttgagggggtagtggcgaaagctgtgcgagttcgagtctcgccgtcggcaccaaagttactcaatgccagccgcttctagtggctggcatttttcatttctggggtgtgcttgcggttgtcttgcgatcgcgtgcactccgaaatgattccttccgccggaagtggtattctccggacgctcagaaccaaccgatagaggattgccttgaacctcgcagcctattaccccgtcttgttgttcctcctcgtgggcactggtttaggtatagcgctggtcagcatcggcaagcttcttggtcccaacaagccggacgtcgagaagaacgcaccgtacgagtgcggcttcgaagcctttgaagacgcccggatgaaattcgacgtccggtactacctcgtcgccatcctgttcatcatcttcgatctcgaaaccgcattcctgtttccgtggggcgtcgcgctccgggacatcggctggccgggtttcatcgcaatgatgatttttctgctcgaattcctgctgggctttgcctatatctggaagaaaggcggcctcgactgggagtgatgggttaatcgccggtttgcatgggcggccacgctcggtcgctcgtctggagtggaaagcaaatgagtatcgaaggggtcttgaaggaagggtttgtcaccacgacggctgacaagctgatcaactggacgcgtaccggctcgctgtggccgatgacgttcgggctcgcgtgttgcgccgtcgaaatgatgcatgcgggcgcggcccgttacgatctggaccggttcggcgtcgtgttccgcccgagcccgcgccagtcggacgtgatgatcgtcgccggcacgctctgcaacaagatggcgcccgcgctgcgccgcgtgtacgaccagatggccgagccgcgctgggtgatctcgatgggatcgtgcgcgaacggcggtggctactaccactactcgtactcggtggttcgcggctgcgaccggatcgtaccggtcgacgtctacgtgccgggctgtccgcccacggccgaggcgctggtctacggcgtgatccagcttcaggcgaagatccgccgcaccaataccatcgcccgtcaataaagccccgagcgtcccctcaatatggcaagcaaaatcgagaccctcaaggcaaacctcgaagccgcgctcggcgcgcgcgtggtgagcctcaccgaagcgatcggtgaactgacgctcgtcgtgaaggcgagcgattacctcgaagtcgcaaagacgctgcgcgacgatccgaagctccgtttcgagcagctgatcgacctgtgcggcgtcgactaccagaccttcggcgacggcgcctacgacggcccgcgtttcgcggccgtgtcgcacctgctgtcggtcacgaacaactggcgtctgcgcctgcgcgcattcgcgccggacgacgacctgccgatcgtggcatcgctggtcgacatctggacttccgcgaactggtacgagcgcgaagcgttcgacctgtacggcatcgtgttcgaaggccaccccgacctgcgccgcatcctcaccgactacggcttcatcggccacccgttccgcaaggacttcccggtgtcgggctacgtcgaaatgcgttacgacccggaagagaagcgggtcgtgtaccagccggtgacgatcgagccgcgcgaaatcacgccgcgcgtgatccgcgaggatcgctatggcggtctgaaacattaaggggcgtcatggcagaaatcaagaactacacgctcaacttcggcccgcagcacccggcagcgcacggcgtgctgcgcctcgtgctcgagctcgacggcgaagtcattcagcgtgccgatccgcacatcggcctgctgcaccgcgcgacggaaaagctcgcggaatccaaaactttcatccagtccgtgccgtacatggaccgtctcgactacgtgtcgatgatggtcaacgagcacggctacgtgctcgcgatcgaaaagctgctcggcatcgaagtgcctgagcgcgcccagtacatccgcgtgctgttcgacgagatcacgcgcgtgctgaaccacctgatgtggatcggcgcgcacgcactcgacgtcggcgcgatggcggtgttcctgtacgcattccgcgaacgcgaagacctgatggacgtgtacgaagcggtgtccggtgcccggatgcacgcggcgtactaccgtccgggcggcgtctaccgcgacctgcctgacgcaatgccgcaatacaaggcgtcgaagattcgcaacgagaaggcgctcgcgaagatgaacgaagcgcgcagcggctcggtgctcgacttcatcgacgacttcttcacacgcttcccgaagtgcgtcgacgaatacgaaacgctgctcaccgacaaccggatctggaagcagcgtctggtcgggatcggcgtggtcagcccggaacgtgcgctgcagatgggcctgacgggcccgatgctgcgcggctcgggcatcgcctgggacctgcgcaagaagcaaccgtacgaagtgtacgatcgcatggatttcgacgtgccggtcggcgtgaatggcgattgctacgaccgctacctggttcgcgtcgaagaaatgcgccagtcgatccgtatcgcgaaacagtgtattgagtggctccgcaagaatccgggcccggtgatgaccgacaatcacaaggttgcaccgccgtcgcgcgtcggcatgaagaccaacatggaagacttgattcaccacttcaagctcttcaccgaaggtttccatgtgccggaaggcgaagcgtacgcggcggtcgagcatccgaagggtgagttcggcatctacctcgtgtcggacggtgccaacaagccgtatcgcctcaagattcgcgcaccgggtttcgcgcacctggcgtcgctcgacgaaatggcgcgcggtcacatgatcgccgacgccgtcacgatcatcggtacgcaggacatcgtgttcggcgaaatcgatcgctaatggttgcgccgcccgtttgtcgcgggcggcgagcggtaagtcacacgcgaagtcacatgctgcatgcgctgaaccggcgcggcttcgcaagctgtcaacagagtgagcgccaggtctgccgtccatgcaccccagtgtgcggcaggttgttcgttcggtaggaattgaaagagtcgtgtctgaaaatgatctcagctgaaggcctgaaggaaatcgatcgagcgttgacgaagtatcccgccgatcagaaacagtccgccgtgatgtcggcgttggccgttgctcaggaagagcacggctggctgtcgcccgaactgatgcagttcgttgcggactatctcggcatgccggccgttgccgtgcaggaagtcgcgacgttctacacgatgtacgagctcaacccggtcggcaagcacaagatcacgctctgtacgaacctgccgtgccagcttggcccgcacggcggcgcggaagcgactgccgactacctgaaacagaagctgggcatcggcttcggcgagaccacgcctgacggcaagttcacgctgaaggaaggcgaatgcatgggctcgtgcggcgatgcgccggtgctgctggtgaacaatcacagaatgtgcagcttcatgagccgcgagaagatcgaccagctgcttgaggagctctcgaaatgacgtccctccacgaccgtcacatcaaaccgctgatcctcgctggtctgaacggcgagaactggcatctcgaagattacgtcgcgcgcggcggctacaagcagctgcgccgcattctcgaagaaagattccgcccgagcaggtgatcgccgacgtcaaggcgtcgggcctgcgcggccgcggcggtgcgggttttccgaccggcctgaagtggagcttcatgccgcgccagttcccgggcagaagtacctcgtctgcaactcggacgaaggcgagccgggtacgttcaaggatcgcgacatcctgcgctggaacccgcatgcgctgatcgaaggcatggccatcggcgcgtacgcgatgggcatcaccgtcggctacaactacatccacggcgaaatcttcgaagtgtatcggcgcttcgaggccgcgctcgatgaagcgcgtgcagcgggtttcctcggcgacaacatcatgggctcggaattctcgttccagctgcacgcgcaccacggttacggcgcgtacatctgcggcgaggaaacggcgctgctcgaatcgctcgaaggcaagaagggccagccgcgcttcgccgccgttcccggcgagcttcggcgtgtacggcaagccgaccacgatcaacaacaccgagacgttcgccgcggtgccgttcctgctgtccatcgggccgcagaattacctcgagatcggcaagccgaacaacggcggcacgaagattttctcggtgtcgggcgacgtcgagcgtccgggcaactacgaagtgccgctcggcacgccgttcgcgacgctgatggagctcgtcggcgggatgcgcggcggcaagaagatcaaggccgtgattccgggcgggtcgtcggcaccggtgatcccgggcgacatcatgatgcagacggatctcgactacgattcgatcgcgaaggcgggctcgatgctcggttccggcgcggtgatcgtgatggacgagacgcgctgcatggtgcgctcgctgctgcgcctgtcgtacttctactacgaggaatcgtgcggccagtgcacgccgtgccgtgaaggcaccggctggctgtatcgcgtcgtgaaccgtatcgagcacggcgaaggccgccaggaagatctggatctgctgaactcggtggccgagaacatcatgggccgcacgatctgtgcactcggcgatgcggcggcgatgccggtacgcgggatgctcaagcactactgggacgaattcgcgtaccacgtcgagcacaagcactgcatggtcggcggccacgcgcacgcggcggcggcctgaagcgaacccggttgcggaatttgagcgcacggtcgggcgaaggcgcgaacgggcggaaataggttaaggaccattcaccatcatggttgaacttgaaatagacggcaagaaggtcgaggtgcccgaaggcagcatggtgatccaggctgcgcacaaggcggatacgtacattcctcacttctgctatcacaagaaactgtcggttgcggccaactgccggatgtgtctcgtcgaagtcgagaagatgccgaaggccgtgcctgcctgcgcgactcccgtgtcggccggcatgatcgtccatacgcaatccgacaaggccgtgaaggcgcagcagtcggtgatggaattcctcctcatcaaccacccgctcgactgcccgatctgcgatcagggcggcgaatgccagctgcaggatctggcggtcggctacggcaagtcgtcgtcgcgctactcggaagaaaagcgcgtggtgttccacaagaacgtgggcccgctgatctcgatggaagagatgtcgcgctgcatccactgcacgcgctgcgtccgcttcggccaggaaatcgccggcgtgatggagttcggcatgctgggccgcggcgagcactcggaaatcacgacgttcgtcggcaagacggtcgattccgaaatgtcgggcaacatgatcgacctgtgcccggtcggcgcgctgaccagcaagccgttccgctacagcgcccgtacgtgggaactgtcgcgccgcaagtcggtgagcccgcacgattccgtcggcgcgaacctcgtcgtgcaggtgaagaacaaccgcgtgatgcgcgtgctgccgttcgagaacgaagcgatcaacgaatgctggatctcggacaaggaccgcttctcgtatgaaggcctcaacagcgaagagcgcctgacgaagccgatgctgaagcagggcggccagtggatcgaaaccgactggcagaccgcgctcgaatacgtcgcgaagggcctgaagggcatcgccgcggatcacggcgcgaacgcgctggcgatgcttgcgagcgcgcacagcaccgctgaagagctgttcctcgtgaagcagctcgccaacgaactgaagacgccgaacgtcgatttccgtctgcgtcagcaggatttctcggcgccggtccagggcgcaccgtggctcggcatgccgatcgccgacctgtcgaacgtggatgccgcgttcgtcgtcggttcgttcctgcgccgcgaccacccgctgtttgccgcccgcctgcgtcaggccgcgaagaacggcgcgaagctgcacttcctgcacgcgaccggtgacgatgcactgatcccgaccgcgcagcgcatcgttgccgcgccgtcggcatggctcgaccagctggccggcatcgctgccgcggtcgcgcaactgcgcggcgtcgcgctgcccgacgcgctggcaggcgtcaccgcatcgccggccgcgcaggctgtcgcccagtcgctcgcgaacggcgaacgccgtgcggtgctgctcggcaacgtcgcggtccgccatccggaattcgcgaagctgcacgccgtcgccaagtggatcgccgacaacaccggcgccacgttcggcttcctgacggaagcggcgaacacggtcggcgcgcacgtcgtcggcgcactgccgggcgaaggcggcttgaacgcacgtgaagcgttcgcgcagccgcgcaagggctacgtgctgctgaacgtcgagccggaattcgacaccgctgatccggcacaggcgctggccgcgctgaaccaggcggaaatggtcgtcgtgatgtcgccgttcaagcacggcctcgactacgccgacgtgctgctgccggtcgcgccgttcacggaaacggccggcacgtacgtgaatgcggaaggcaccgtgcagagcttcaacggcgtcgtgcgcccgctcggcgacacgcgtccgggctggaaggtgctgcgcgtgctcggcagcctgctcggcctgccgaactttgaatacgagaccgcggaagaagtgcgtctcgctgcgctcggcgacgccggcgtcgcgggccgcctgtcgaaccagacgtcggtcgcgccggtgcgcgccgccgcgaatgccgcgaacggcggcttcgagcgtctggccgatgtgccgatctatcacgccgacgcgctcgtgcgccgcgcaggtgcgctgcacctgacggccgccgcgaaggcggcgaatgccgcagccctgccggccgcgctgttcgacaagctgggcttgaaggaaggcgacgcggtgcgcgtgcgccagggcgagcgtgcggtgcagttgccggccgtgcgcgacgcgaatcttgcggagacggtcgttcgcgtgtcggcggcaacgcctgccggcgcagcgctcggcagcctgtccggtgaactggtggtggagaaggcgtaaatgagcttgttcgatacgatcaacgcgggcgggtcccagcttctcggcttcgcatggccgacggtgtgggccgtcgtgcgcatcctcgtcgtctccgtcgtcatcctgctgtgcgtcgcgtacctgattctgtgggaacgcaagctgatcggctggatgcacgtgcgtctcggcccgaaccgcgtcggccccggcggcctgctgcagccgatcgccgacgtgctgaagctgctgctgaaggaagtcattcagccgagcgccgccagccgctggctgtacctgatcgcgccggtgatgaccgtcgtgccggcgttcgccgtgtgggccgtgatcccgttccaggccgaagcggtcctcgcgaacgtgaacgcgggcctgctgtacgcgatggcgatctcgtcgatcggcgtgtacgcggtgattctcgcgggctgggcatcgaactcgaagtacgcgttcctcggcgcgatgcgcgccgcggcacagatggtgtcgtacgaaatctcgatgggcttcgcgctggtgctggtgctgatgacggccggcagcctgaacctgtcggaaatcgtgggttcgcaacagcacggtttcttcgccggccacggcgtgaacttcctgtcgtggaactggctgccgctgctgccggcgttcgtcgtctacttcatttcgggcatcgccgaaacgaaccgccacccgttcgacgtggtggaagggagtcggaaatcgttgccggtcacatgatcgattactcgggcatggcgttcgcgctgttcttcctcgccgagtacatcaacatgatcgtgatctcggcgctggctgcgacgctgttcctcggtggctgggacgcaccgttcgaattcctgtcgttcatcccgggcatcttctggctggtgctgaaggtcttcgcactgctgtcggtgttcatctgggtccgcgcgacgttcccgcgctaccgttacgaccagatcatgcgtctgggctggaaggtgttcctgcccgtcacggtgatctgggtggtcgtggtcggctgctggatgatgtcgccgctgaacatctgggtgaagtaaggacgaaatcatgacggctatccaacacttctttaagactttcttcctgaccgagctgctgaaggggctcgcgctgaccggtcgttacacgttcaagcgcaagttcaccgtgcagttcccggaagagaagaccccgatttcgccgcgcttccgcgggctgcatgcgctgcgccgctatgaaaacggcgaagagcgctgcatcgcgtgcaagctctgcgaggccgtgtgccccgcgatggcgatcacgatcgaatcggaaacgcgcgcggacaacacgcgccgcacgacgcgctacgacatcgacctgacgaagtgcatcttctgcggtttctgcgaagagagctgcccggtcgattcgatcgtcgagacgcagattctcgagtaccacggcgaaaagcgcggcgacctgtatttcacgaaggaaatgctgctcgcggtgggcgatcgctacgagaaggacatcgccgcggcgaaggctgccgacgcgccgtatcgttgattgtgtttgcagtgccggcccgaagcctgggccgagccgccgcgacgggtgcggcacgcgagagcgtcccgcaagccgcgcctgactatggcctaacgatgaaccggtaatcatggaattcacgaccgtactgttctacatcttcgcgctgctcctggtggtatcagggctgaaggtgatcacttcgcgcaacccggtggcgtctgcgcttttccttgtgctggcgttcttcaacgccgccgcgatctggatgctgctggaagcggagttcctcgcgatcctgctggtgctggtctacgtgggcgccgtgatggtgctgttcctgttcgtcgtgatgatgctggacatcaacatcgactacctgcgccgcgacttcaagcgcttcgtcccgatggcgaccgtggtcggcgcgatcatcgtgatcgaaaccgcgctgatcctgtggcgcggttacggcgacacgcagacggtgcacgcgatggcgacgggcgaaatggccaactggtcgaacacgcgactgatcggcaaggtgatctacaccgactacatcttcgcgtttgaaatcgccggcctcgtgctgctggtcgcgatcattgccgcgatcgggctgaccgagcgcaagggcaaggacagcaagcgccagcgcgtgtcggatcaggtcaaggtgcgccgcaacgaccgtgtgcgcctcgtgaagatggaagcggacaagccgcagccggaaacggcgcagagcgaagccggttcgggcaccaacggctaagcggaggaaaggaaaaccatgctgactcttgctcattacctcgtgctcggcgcgatcctctttgcgatcgcgatcgtcgggatcttcctgaaccgccgcaacgtcatcatcatcctgatgtcgatcgaactgatgctgctggcggtgaataccaacttcgtcgcgttctcgcactacctcggcgatgtgcacggccagatcttcgtgttcttcgtgctgacggtcgccgcagcggaagccgcgatcggcctcgcgattctggtgaccctgttccgtaagctcgacacgatcaatgtcgaggatctcgatcagctcaaaggttaatttcaggcaacgctgttatgtcaacgacactcaatgaaaacctgctgctggcgattccgctcgctccgctggccggctcgctgattgcggggctgttcgggaacgcagtcgggcgcaagggcgcacaccggatcacgatcctcggcgtaatgatcgcgttcctcctgtcggcgaaagtcttcttcgacgtgatgggcggcgcaagcttcaacgcgaccgtctacgaatggatgaacgtcggctcgctgaagctcgaagtcggcttcctcgtcgattcgctgaccgcgatgatgatggtcgtcgtgaccttcgtctcgctgatggtgcacgtgtacacgatcggctacatggcggaagaggacggctaccagcgcttcttctcgtacatctcgctgttcacgttctcgatgctgatgctcgtgatgagcaacaacttcctgcagctgttcttcggctgggaagcggtgggtctggtgtcgtacctgctgatcggcttctacttcacgcgtgagagcgcgatctacgcgaacatgaaggcgttcctcgtgaaccgcgtgggcgacttcggcttcctgctcggcatcggcctgctgctcgcattcgccggctcgatgaactacggcgaagtgttcgcgaagcgcgcggaactcgcgagcctgcacttcccgggcaccgactggggcctgctgaccgtggcctgtatctgcctgttcatcggcgcgatgggtaagtcggcacagttcccgctgcacgtgtggctgccggactcgatggaaggcccgaccccgatctcggcgctgattcacgcggcgacgatggtgacggccggcatcttcatggtgtcgcgcatgtcgccgctgttcgagctgtcggacaccgcgctgtcgttcgtcacggtgatcggcgcgatcacggcgctgttcatgggcttcctcggcatcatccagaacgacatcaagcgggtggtcgcctattcgacgctgtcgcagctcggctacatgacggtcgcgctcggcgtgtccgcgtacccggtcgcgctgttccacctgatgacgcacgcgttcttcaaggcgctgctgttcctcggcgccggctcggtcatcatgggcatgcaccacgaccaggacatccgcaacatgggcggcctgcgcaagtacatgccgatcacgtggatcacgtcgctcatcggttcgctcgcgctgatcggtacgccgttcttctcgggcttctactcgaaggactcgatcatcgacgcggtgaagctttcgcacctgccgggttcgggcttcgcgtacttcgcggtcgtcgcgagcgtgttcgtcacggcgctgtactcgttccgcatgtatttcctggtgttccacggtgaagagcgcttccgcaagccgaagcatccggaatcgccgatgggcatggcggccgcgcacggccacgacgaccacggtcatggccatggtcatgacgaccacgcgcacgagccgcacgagaccccgtgggtcgtgtgggtgccgctggtcctgctggcgatcccgtcggtgatcatcggtgcaatcgcggtcggcccgatgctgttcggcgacttcttccagcacggcgttgcattcgacaaggtgatcttcatcggtgaaaaccacccggcgctggccgagatggccgaggagttccacggctgggtgggcatgggcctgcactcggtgtcgggtctgccggtctggctcgcgctcgccggtgtcgttgtcgcctggttcctgtacctgaagcgtccggatctgccggcgtcgatccgccgcgcgttcggcccgatctacacgctgctggacaacaagtactacatggacaagatcaacgaagtggtgttcgcccgtggttcggtggcgatcggccgcggcctgtggaaggaaggtgacgtcgtcgtgatcgacggcctcgtcaacggcagcgcccggttcatcggctggttcgccagcgtgatccgcttcctccaatccggttacatctatcactacgcgttcgccatgatcatcggcatgctggggctcctgaccctgtttgtaacgctcggcggcaaataaggcggggacaacttaatgcacgcttttccgattctcagtaccgcgatctggctgccgatcgttttcggcctcctcgtgcttgcggtgggtaatgacaaaaatccggggacggcccgctggatcgcgctgatcggttcgctgctcggcctcgcggtcacgatcccgctgatcacgggcttcgattcgagcacggctgcgctgcagttcgtcgagaagtcgacctggatcgagcgcttcgacatcgcgtatcacctcggcgtcgacggcatctcgatgtggttcgtcgtgctgaccgcgctgattacggtgatcgtcgtgatcgccgcatgggaagtcatcaccgagaacgtcgcgcagtacctcgcggcgttcctgatcctgtccgggatcatgatcggcgtcttctcggcggccgacggcctgctgttctacgtgttcttcgaagcgaccctgatcccgatgtacatcatcatcggcgtgtggggcggcccgaaccgcgtgtatgcggcattcaagttcttcctgtacacgctggccggctcgctgctgatgctggtcgcgctgatctacctgtacacggaaacgcattcgttcgacctcgcgacgtggcagaacgccaagatcgcgatgacgccgcagatcctgctgttcatcgcgttcttcctcgcgttcgcggtgaaggtgccgatgtggccggtgcacacgtggctgccggacgcgcacgtggaagcgccgacgggcggctcggtcgtgctggccgcgatcatgctgaagctcggcgcgtacggtttcctgcgcttctcgctgccgatcacgcctgacgcgagccacttcctggcccccgtcgtgatcacgctgtcgctgatcgcggtgatctacatcggcctcgtcgcgatggtgcaggccgacatgaagaagctggtcgcgtattcgtcgatcgcgcacatgggcttcgtcacgctcggcttcttcatcttcaaccagctcggcgtcgaaggcgcgatcatccagatgatctcgcacggcttcgtgtcgggcgcgatgttcctctgcatcggcgtgctgtacgaccgcgtgcactcgcgccagatcgccgattacggtggcgtcgtcaacgtgatgccgaagttcgcggccttcgcgatgctgttctcgatggccaactgcggcctgccgggcacgtcgggtttcgtcggcgagttcatggtgattctcgcggccgtccagtacaacttctggatcgcattcggcgcggcgttcacgctgatcctcggcgctgcttacacgctgtggatgtacaagcgcgtgtatttcggcgcggtggcgaacgaccacgttgccaagctgaaggacatcggccgtcgcgaattcctgatgctggccgtgctcgccgcgttcacgctgctgatgggcctgtatccgaagcctttcaccgacgtgatgcacgtttccgtggaaaacctcctctcccatgtcgcgcagtccaagctgccgctggcgcagtaatcgcgagcggaggaaatcaagatcatgaacgctcctatgaatgtcctgttgcctgacgcgctggtgatggccgccatcgtcgtcgcatggctgaacgacacctttaccggtgcttccggccgccgcctgacttacctgatcgcggttgtttcgtcggtcgtcgccggcgtgtggttcgcggtgcaggcactcgacccgcagcagtactacttcttctcgaagatggtcgtcgtcgactcgttcgcgagcacgatgaaggccgtcgtgtcgttcggtttcgcggtctcgctcgtctattcgcgcaagtacctcgaggatcgcgacatgttccgcggcgacgtgttcctgctcggcatgttctcgctgctcggccagctggtcatggtgtcgggcaacaacttcctgacgctgtacctcggtctcgaactgatgtcgctgtcgctgtacgcagtcatcgcactgcgccgcgacgccgcgcagtcgagcgaagccgcgatgaagtactacgtgctgggcgcgctcgcatcgggcttcgtgctgtacggcatctcgatgctgtacggcgcgaccggctcgctcgagctgggcgaggtgtacaaggcggtcggcggcaacaccgacgcagccgtgctgatgttcggcgtggtcttcatcgtcgccggtatcgcgttcaagctcggcgccgtgccgttccacatgtgggtgccggacgtctaccagggcgcaccgaccgcgatgacgctgttcgtcggcggcggcccgaaggttgccgcgttcgcgtggggcctgcgcttcctggtgatgggcctgctgccgctcgcgcagaactggcagaccgcgctcgtgatcctcgccgcgctgtcgttgatcgtcggcaacatcaccggtatcgtccagcgcaacatcaagcggatgctcgcgtactcggcgatctcgaacatgggcttcgtgctgctcggcctgctcgcaggcatcgtgaagggcgacgcgtcggcgccggcgaatgcatacagctcggcgatgttctacgcgatcgtctacctgatcacgacgctcggctcgttcggcgtggtgatgctgctcgcacgccgcgatttcgaagccgacacgatcgacgacttcaagggcctcaacaagcgcagcccggtgttcgcgttcgtgatgatggtcatgatgttctcgctggcaggcatcccgccgaccgtcggcttctacgcgaagctcgccgtgctcgaggcgaccgtcaacgcgggcctcacgtggctggccgtgctggccgtgatcacgtcgctgttcggcgccttctactacctgcgcatcgtgaagctgatgtacttcgatgcaccgcaggatgcaacgccgatcactggtgatttctgcaagcgcacgatcctcgtgctgaacggcctggcggtcgtcgtgctcggcctgatcccgagcccgctgctgacggcctgcctgcaggcaattcgccacacgctgccgctgtaatgtcggcagccggctggtttatcgtgctgttggcgttcgtctgcgccaacctgccgttcctgaaccaacgcctcttcgccgtcgtgccgttcggcgcgacgaagaagggcgggtgggtgcggatcggcgagctgatcgtgctgtacttcatcgttggcgcgctcggcttctggctcgagtcgcgcgccggcaaccgcttcgaacagggctggcagttctacgcgatcacgttcagtcttttcgtcgtgttcgcgtttcccggcttcacgttccagtatctcgtcaaacgacgctgacggcttcggccgtcgcgctcattcccggagccgccgatggccgaactacccaatcacgacgccgcactgaccgaaacctgcctcgagagcgaggcgattttcgacggcgcgttcctcaagctcaagcgcgatatcgtccgcctgccggatggcaagaaggccacgcgcgaatacgtccagcatccgggcgcggtgatggtgatcccgctgttcgacgacggccgcgtgctgatggaaaaccagtttcgctacccgatcggcaaggtgatggccgaattcccggccggcaaactcgacccgaacgaaggcgcgctcgcctgcgcggtgcgcgaactgcgcgaggaaacgggttacaccgcacgcgagtacgtgttcctgacccgcattcatccgatcatttcctactcgaccgaattcatcgacctgtacctggcgcgcgggctgacggccggcgagcgcaagctcgatgagggcgaattcctcgagaccttcaccgcgacgcaggccgatttgcaggaatgggtgcgcacgggccagatttccgacgtgaagacgatcatcggtacgatgtggctcgacaaggtgctgtccggtacgtggccgctcgggccggtcctgacgccctgagtgcggcgtcagcggcgggtggggcgccgcgttacaatccggtgacgcgacgcctccacgtcgcgcgatcggcaattagcacgatcgttcacaaaaccgctttttgcgctacactcgccacacgccctgattcagcatgaaggtcctcgatttgcagtgcccgcacggtcatcggttcgaaggctggttcgcttccgccgatgaattcgaagcgcagttgtcccgcaagctggtcgaatgcccggtgtgcggaacgaccgaggtcaaccgtctgccgtcggcgccgcgcctgaatctgtcgggtgcgacgcaggcacagccggccgattcgcgcgcaatgcaggcgcaggtgatgcgtgcactgcgcgaggtgctggagaaaaccgagaatgtgggcgagcgcttcgccgaggaagcgcggcgcatccattacaacgaggcgccggcacgcagcattcgcggtgtcacgacgcccgaagatgcgcaatccttggccgaagaaggcatcgacgtgatgccgctgccgattcctgccgcgctgaaagaaccgctgcaatgacgtatgcagtgggtccttgccgggctggacggccgcggcctgcgtctgcatgggaccggagtaagtgttgaagcactacctccggtcgacaggagacactgcgcatggatctggattattccccgccgacgacgcgttccgcgtcgacgtccgcgcctggctcgaggccaacctgcctcacgcactgcgcgccaaagtactcgatcacaaacgactcgaccgcgaggatttcgcgagctggcaccggattctcggccagcgcggctggtccgcgcccgcctggccggttgaatacggcgggccgggctggaacgcgacgcaacggcacatctgggacgaggagtgcgcgcggatcggtgcaccgaccgtgctgccgttcggcgtatcgatggtcgcgccggtgttgatgaaatacggcagcgaagcgcagaagcgtcattatctgccgcggattctcgacggctcggactggtggtgccagggctattcggagccgggttcgggatccgacctcgcctcgttgcgcacgcgcgccgagcgccagggcgaccactacatcgtcaacggccagaagacctggacgacgctcggccagtacgccgacatgatgttctgcctcgtgcgcaccgatccggccgcgaagaaacaggagggcatctcgttcctgctgatcgacatgaagacgcccggcattacggtgaggccgatcgtcatgctcgacgaggaccacgaggtcaacgaggtgttcttcgaggatgtgaaggtgccggtcgagaatctcgtcggcgacgagaatcgcggctggacctacgcgaaatacctgcttggccacgagcgcaccggcatcgcgcgcgtcggcgcgtcgaagcgcgagctcgcgttcctgaagcgcgtggcgtcgaaccagcgcaagaacggtaagccgttgcttgccgatcccgtgttcgccgccaaggtcgcggcgctcgaggtcgagctgatggcgctcgaggtgacggtgctgcgcgtcgtcagccgcgagacgagcgggaagggccgggccccgaggcgtccatgctgaagatcaagggcacggaagtgcagcaggcgcttaccgaactgatggtcgacgcgatcggcccgctcgccgcaccgttcgacgttccgttcctcgacggccagcgcgagcacagcatcgccggcgacgacgacgcggcgccgctggccgcgtactacttcaactaccggaagacgtcgatctacggcggttcgaacgagatccagaagaacatcatcgcgcagatgattctggggctgtgatcagggaacggagacaaccatggatttcagctttaccgatgagcagcagcagttcgccgacgcgctgcgtcggtatctcggcgagcaatacggcttcgaagcgcgccaggccatcgtgcgcagcgacgcgggcgtgtcggacacgcaatggagcgccttcgccgagctggggttgaccgcgctgcccgtgccggacgcacagggcggcttcggcggcggcccggtcgacatgctggtcgtgatgcaggaactcggccgcgcgctcgtgatcgagccgtactgggcaacggcggtgggtgtcgaggccttgcgcatcgccggctccggcgccggtgaggatgccgcgctgctggaggcggtcgcgcaggggcagaaacgtgttgcggttgctttccacgagccgcatgcgcgctacgacctgttcgaactcgatacgcatgcgcgcgagcagggcggcacgtaccgcctgacgggcacgaagtcggtcgttcagcatggcgcgcaggcgcatgcgtggatcgtgcctgcgcgcgtcgacgacggcggcatcggcctgttcgtcgtcgaacgggatgccgcgaatgcgaaggtggccgactaccggacgatcgacggccagcgtgccgcgacgatcggtttcaatgaaacgccggcgcgactgctgacgggcggggcgcgcgacgccgccgccctcgagcaagttgccgattacgcgacgttcctgctgtgcgcggaggcggtcggcgcgctcgacgaactgaaccgcgccacggtcgaatacacgaagacgcgcgaacagttcggcatgccgatcgcgcggtttcaggcactgcagcaccggatggtcgacatgctgatccatgccgagcaggcacgttcgctgacctacctggcagccgtgcgctacgcgagtggcgatgccgacgcgcggcgcaaggcggtgtcggccgcgaaagcgcgtgtcggcgccgccgcgcgtttcgtcggccagcaggccgttcaactgcacggcggcatgggcgtgaccaacgaggtcgccgctgcgcacctgttcaagcggctgacgatcatcgagacgacgctcggcgacaccgatcatcatcttgcgcgcatcgcggcactgcccgatttcgcgcaggccgacgcggcatgacggcgacgcgcgagcgcgccagacaaggagacatctagtgggcatcagttacgaagacctggtggtcggcagcaccaccgaagtgggccgttacacgttcgaacccgacgacatcaagacgttcgcgcaacgctacgatccgcagccgttccatctcgacgaagaagccgggaaggcatcgcatttcggcgggcttgtcgcgagcggctggcatacgtgttcggtgttcatgagcctgctcgtcaagaagctcggccaggactcgaccagcatgggctcgccgggcatcgactcgatccgctggctcaagccggtgcgtgcgggcgatacgatcacgatgtaccagaaggtccacgacaagcgcgtgtcggagagcaagcccgatcgcggtatcgtgtcgacggaatgggtcggcgtgaacgaggccggcgagacggtgattaccgtgcacacgaaagtgatcttcgggctgcgccatccgggaggcgtgcaggcatgacggagatgacgttgccgctgatcgcgtcggcgcaggcgctgcaggcacgcgtcggcgcggagccgctcgcgagcggctggatcgcgatcgaccagcatcgcgtcgacgggtttgccgacgcgaccggcgatcatcaatggattcacgtcgatcccgagcgcgcgcgacgcgagtcgccgttcggcggaccgatcgcccacgggttcctgacgctgtcgctgattccggcgttgatgaccgacgcgatgcgtttcgagcagaagatgggcgtgaactatggactgaaccgcgtgcggttcctgaagccggtgccggtcggcgcgcgcgtgcgtgcgctgtttgcggtaaaggaaaccgccgaggccgcgcggaacggcgtgcaggtgacgtggtcggtgacgatgcaggtcgagcgtcccgatgcgccgctgccggtttgcgcggcggaattcatcacgctgcattacttctgaagcggggagcggcatgcatggatgccgctccgcccgtcacttgcgtgtcagtgcttcgcgtattgcgttgcgccgaacagcacctcgcgtgccttgtcgtcctgcagcgccttgcgcatcgacgcgagcacttcgacaccgcgctgcacggccggtcgtgcggcgatcgtgtcgtaccagcgcttcacgttcggcaattcgtcgagcacgatgccctggttctgccatgagcgcgtccacgggaacgtcgcaatgtccgcgatcgtgtacgtgtcgcccgcgagatattcggactcgccgagtcgcttgtccatcacgttgtacaggcgcttcgcttcgtttgtgtagcggttgaccgcatactcgatcttctccggcgcatacaggcggaagtgatgcgcctgcccgagcatcggcccgacaccgcccatctggaacatcagccattcgagcgttgcatagcgtgcggccggatcggtcggcaggaacttgccggtcttctccgcgaggtagatcaggatcgcgcccgattcgaacagcgagatcggcttgccgccggggccgtccggatcgacgatcgcggggatcttgttgttcgggctgatcttcaggaattccggcttgaactggtcgcctgcgccgatatcgaccggatggacacgataggcgaggcccgtttcctcgagcatgatgtgcaccttgtggccgttcggggtcgcccagctatagacgtcgatcatcgtgaactcctttgttgcgtgcgcgaaaacggcgctggcagcgccgcgacaggcggtcattagagcatggatcgatgcgcgctgctggcgacgcaaacgtgcgtgccgatacgggtacgcgggcgagcgagcgctcgccgccgacgtcgcgcgcggcgcttcgtggcggatgcgttcaggcaggtggaacgcgggcgtggcgactcagcgcttgtagcggggcgggcgcttctcgagaaatgcggtgatgccctcgagcccgtccgcatgatgcagcgacgcgacgaaatgatcgcgttcggtgccgagatgcgcgtcgagcggttgcgtcgttgcgtcgtcgagcagcgacttgatgcgcgtgagcgcgttcggcgagatgccggcgagtgcatcggcccatgccagcgcgtcggtcaatgccgcgcctggtacggcgagccggttgacgacgccgagcgtgtgcagacgttcggccgcgacgggtttgccttcgaacaggatctcggccgcgagcgcgcgcggcagtgcgcgggcgatgaaccacgaaccgcccccatcgggtgtcaggccgacacgcgcgtatgacatcacgaatttcgcatcgtgcgcggcgacgatcaggtcgcacgcgagcgcgagcgaaaagcccgcgccggccgccgcgccttcgaccgccgcgatcaccggcttcgtcgaagcgtggatcgccgttacccatgcggcgagctgatcgatgctgtcggcctggtaggacggatccttcgagcggttgtcgagcagccggttcaggttgccgcccgcgcagaagaagcgatcggcgccggtgagcacgacagcgcgaatccgggatcgcgctcggcggtggcgagcgcctcgacgccggccgcgtacatgtcgggatgcagcgcattgcgtgcgccgggattgatagcgtgaggacgagcgtcgagtcgctctcgggcggacgcgaggccagcagttcagcactcatgcgagcgtgtctccatcggatggcggggctgcggcgccacgcgcgccgcgcacgcggatgcggccgatgccgtagcggatgtaatgttgtcgtgacgaacgcaatacttgctttagactagcacgaacgtgcttttcagcgcgacgaatctcgctgcggccggcaccgttgcggccgcgttccagcaacgaaggagactccgatgctacagctgtgcggtattccgttgtccaactattacaacaaggtgaagttcgtcctgctcgagcacgacattccgttcgaggagtcggtgtgcggtttgccgatcagcgatccggcccggctcgccgattcgccgctcggcaagattccgttcctgaagaccgaagaaggcgcattgttcgagtcgcaggtgatcatcgaatacctggcggcgcgttatcccgagaaaggcattttcccggcgagcccgttcgcggccgcgaaggtgcgcgaactggtcgagacgctcgagctgtatctcgaatggatggcgcgcgaggtctatacggaagcatttttcggcggcaaggtcagcgacgggacgaaggcgcacgtcgagaagcgcctgccgcgcgcgatcgatgcgttcaaacagatgacgcaattttcgccgtatgtgctcggcgagtcgttcggcctcgccgacatcgccgcatgggtccatctgccagtcatcgggatggcgacgaaggccattttcggacgcgatttcctgctcgacgcgggcattgactggaaggcgcacgcgaagatcgtcggcgagcgtccggccgcgcagcgcgtggcagccgaccgcaaggcgtatatcgaggcgacgagcgtcgtgcgttcgtaaacgcggttcctgcaaggcggcctctggccgcccgtgcgggacttacaggcgggcgagccgttcgagcgccgatgcgagcgtgctttcctgcttcgcgaagcagaagcgtacgacgcccgattcgtgcggctcgtgatagaacgccgacaccggaatggcggccacgccgatctccgacgtgagccacttcgagaattccgcttccggcaggtcgctgatcgccgaataatcgacgcactggaagtacgtgcccgtgcagggcagcagcttgaagcgcgtgcgctcgaggccggcccggaagaagtcgcgcttcttctggtagaagtcggcaagcgtcaggtacggtgccgggtcgcgcaggtagtcggcgagcccgacctgcatcggcgtgttcaccgtgaacacgttgaactggtggaccttgcggaattcggcggtcagcgcggcaggggctgcgacataaccgaccttccagcccgtcacgtgataggtcttgccgaagctcgatacgatgaagctgcgcgcggcaagttcaggatagcgcgcgacgctctcatggcgcgcgccgtcatagaccatgtgctcgtagacctcgtcggacaggatcagcacgttggtgccacgcacgatctcttcaagcttgcgcatgtccgcctcgcgccacacggtacccgtcgggttatgcggcgtgttgatcaggatcatgcgcgttttcggcgtgattgcggccgccagacggtcgaacggaatcgcgtagtcgggcgcctccagcgtgacgaacacaggtgtgccgcccgcgagttcgatcgacggcagatagctgtcgtaggtcggttcgacgacgatcacttcatcacccggatgcaccgtgcacaggatcgcggtcagcagtgcctgcgtcgcgccggccgtgacggtgatttcggtcgccggatcgtaacgacggccgtagacctgcgcgatcttgtctgcgatcgcctcgcgcagcggtgcgacaccggccatcggcggatactggttgtgcccgttgcgcatcgcggcggcaaccgcatcgacgatgcgcggatcgcagtcgaaatccggaaagccctggccgaggttcacggcgcctttttctgctgcaagcgcgctcatgaccgtgaagatcgtcgtgccgacgttcggcaggcgcgaagggaaaacgggagtcgttggcatgtctgaaggagcgttcatcgatacagtcgaaatcgggtggtgttgcggtgcgtcaagcaggcgtggcgtcgagcgcgcaggcctcggcaaagggggccggttgcgcgatccggaagccgaaatcgcgcgcggtgcgcttcgcgagcttcagcagcgcgcggtctttcgacacgagccaatcggcctgggcggcgcgggcgagttcaagaaatttctggtcgtcgcggtccttgcacttcggcagcggcggcgcgtcggcgtcgacggccggcggctcgacgaggctcgccaggcgggcgacggttgcgagcgcggccgccttgtcgacggcgcgcgcctggaattgcggataatcgagcacatactcgagttcggtcaggcagcggccgtcgatcacggcggcaagcgtgccgcgttcgagcgcggcgcggatcgggcgcgtagcggggtcgtcgaatacgaggatgtcgatccagacgttcgagtcgagcacgacgcgatgcgcggcatgcggggcgggagagcgggtcattcgttacaatcggtggttttcgtctgaccgcaaggcacggcgtgccagcgagcctctatgataatcgttctctctcccgccaaatccctcgactacgatacgcccgcgcacgtccagtcttacacgaagcctgcattcgtcgacgacgcgtccgagctgatcgacggcctgcgcaagctttcgccgcaggacatcgcgacgctgatggatatctccgatccgcttgcacgcctgaatttccagcgctacgcggactggtcgccgacctttacgccggccaacgcgaagcaggccgtgctcgcattcaacggcgacgtatatgaaggattcgacgccaaatcgctgtcgtccgccgatctcgactatgcgcagcagcacgtgcgcgtgctgtcggggctgtacgggctgctgcgtcccctcgatctgctgcagccgtaccgtctcgagatgggtacgcgtttcgcgaacgcgcgcggcaaggatctgtacgcgttctggggcgaccgcatcacgcgggcgctgaacgagcagctcgaaacgcgcagcggcgcggcgcgcgtgctcgtcaactgcgcatcgaccgaatacttcaagtcggtcaagccgaaactgctggccgcgcccgtcgtcacgccggtgttcgaggactggaagggcggccgctacaagatcatcagcttccatgcgaagcgtgcgcgcggcctgatggcgcgttttatcgtcgagaatcggattgccgacccgaaggcgctgaaggagttcgcgacggaaggctatgcgttcgatgcggctgcgtcgaacgattcgacttacgtatatcgccggcgagtcggcgagtgaccctgccggccgttcacgagacggccggcgcatgcatgaggccggacaagcgctacaccgcctgttccggccgccagctttacatgtgaccggtgtaagcgctaaagcgccaactccggtcgacaaagagagacagatggccctttcgatcaccagcaatttcgacgcaggcgcaatcgacgtcgtgtcgtgcgacagccccgatgcgattcggttgcgcgtgcgcggcgacaaccgttcggaattcgcgcaatggttttactaccgcttgacgggcgcgcgcgagcgctgtgtgatgacgttcgagaatgctgtcgaatgcgcgtatccgtcgggctggcgcaattacagcgcggtggcgagctatgaccgggtcgactggttccgcgtgccgacgacgttcgacggcaagacgatgaccatcgaccatacgccggaattcgacagcatctactacgcatatttcgaaccgtactcggaagagcgtcatgcggcatttctcggtgcggtccagcagttgccgcaggcgagcgtcgtcgaactcggtcgcacggtcgaaggtcgtccgatgtcgctgctgacgctcggtacgccggagaccgacggcgcaccgaagaagaaggtgtggatcatcgcgcgccagcatcccggcgagtcgatggccgagtggttcgtcgaaggtctcgtcaagcggctggccggatggggcgactgggccggcgatccggtcgcgcgcaagctctacgatcgcgtgacgttccacatcgtcccgaacatgaatccggacggcagcgtgcatggcaacctgcgcaccaatgcggcgggcgcgaacctgaaccgcgagtggatggcgcccgatgccgagcgcagtcccgaggtgctggccgtgcgcgatgcgatccatgcgatcggctgcgacatgttcttcgatatccacggcgacgaggatctgccgtacgtgttcgttgccgggtcggaaatgctgccgagctttaccgagcagcagggcaaggagcaggctgcgttcatcgaagcattcaaggttgcgagccccgacttccagactgagcatggctatgcggcgagcaagtacaaggaggacgcgctcaagctcgcgtcgaagtacatcggccaccagttcggctgcctgtcgctgacgctcgagatgccgttcaaggacaacgcgaacctgcccgacgagcgagtcggctggaacggcgagcgaagcgcggcgctcggcgcggcgatgctggctgcgatcctggtgcacgtcgacacgttcgcgtaagcgcagcgtcgccgtatgaaaaagccggagcatctcaggatgctccggctttttgcttctgttgatgtcgcttcgtcgaatcaggacttcttcgcgctcttcttcacgaccttcttctgtccgctcgacttttcgttgcggcggccttcttgctgccggtgcggctcgatgctttcgccttgaccttgcctcggtgcgacttgcccttgaacttcttcgtcgaggacgtggagcgctcgacgcgcggcttcagcggcggaaccgggtcgttccagctgaaggcgagcatttgctgaccgacatagccgcatcggaatttcagcggcgtcgggtcgctgccgtcgctgtggatgccgagcccatcgacagtgacgatattgtcgaccttcacgcgctgcttgccctggtcgaacgagtcgttccatggcgtgattgtcgcgttgccgctgtcgaatgtgttcggcgcgaagtcgacgcggtcgaacgccgacgacgtgctggcgatgaagctgccgtgcgccgcacaatcggcggcgagcggatcggcatgcatttcgttgacgaatttgttgatcagttcggagcgctggtcgagcaggtcggcgaatgccggtgtcggaagcgcaagcgacaggcccgcaatacaggctgccagcttgccgagcgcccggaaaatccggagcgacgcaggagagctgtccatctggttattggtgaggagcgaatgagacatcgggcacgtatagatgcccgatgaagaaccggagttcaatcttagcgtaaaaagttgtgcggcagtagatgtcgcattctgccgcaccgcgcgaggccctgccggcgggtgatgacggtaccgccgccggagggcgattcaggcgcgcgggccgccgaggcgatagcgccggacgtcgaaggtcgtgacccacgcgggacgatagaccgcgatgagtgccgttgccatgccggtgaaccacgcttcgccgagtgcgagaagcgcggtgttcagcagatagccggccggaatcacgacaggcacgccgtccgccagcgcgagctggaccccggccgcggcagcagcgactgtgatgattgcgatggccggcgacaggaatccctggccggtgatgaacgacgcgagattgtgcggcaaccatgcgagtgcggcgcgctgcagcaatgccgacacgacgaccggcagcgcgccgtagatcagataggtcaggccaatgccctgccagggcgcgtcgaaaatgatcgcggcaaccgccgtgacggcgcccatcgcgatcaatgcgagtgtccagtcgaacagtgtgacgagcagcgtcgcgccaagcagatgcatgacgatgccgtcttcgagccacgcattcgaggcccagaggaccgtaatggcggtgacgagcgcaagccacacgtgctggagcgtggcgtcctgcaggcgcacgaagggacgattccagatcgcgagcgcgagcagggccacggcggcgatccagccaccgatgccaacccagagcgggagcggtgtgaagagaaacccattcgtccatattactcgttgagcatcaaaggtgggaatccacacacgccgaccgtcgcaatatcgagactgtctggctagcgttcgcgccggaaccgcgccgccggttcagcggcgatcggcaagtcctgcgtgctgtcgatcgaggctggcaacgggtacgggcggtctttccgttgcgtacgcagcggaaccgggccctgttcgccgatgggcggcttgcgcgtgcggttgcgattcgccagcagcacctcgaggtggggcgacagccagccgttgtagatcgcgaccgcggcggcgcggttggcggcaccgagttgctggaagatgctggcgaggtggatcttgacggtgccttcgctgatgccgagcgtacgggcgatcatcttgttggtgctgcccatatggacgaagcgcatgatctgagcttggcgtggcgacaagaggccgctcggcggccggcgggaaagcgacccggcgagtgtctggaaatgggcatcgtagcgcgccgcagcagtggaaggcagcagacggagcgcgatcggcgggatgtaatgcccgcccagcagaacgatctcgagcgcacgcacgatcaggtgtggccgggtggaatgcgggatcacgccggagacaccatagttgaagaagcgctggatggcttccggcgatgtttcgtcgacgagaacggcgacgggtgtcggcgagcacgcgctgcagagcgcctgaagctcgctgagtcggccgacgtcgagccagtcgattgcgacgaggtcgaaacgctggttgcgcagcagcctgcgcgcctgaaaactgtcgggcgcatcgttgatgctggcgtgacggttgatctgtcgcaacagagccttcagtccgtcacgccgctcggcgtctgaattgagcatcaggaaccgcatattcaacctccttaatgtgagccattgatttgccgtctggcatgccttgggtctgatgatgacaaagaccttacacgatgtctgcttggctgaaaggcttaggaaaagtatgaaatttcgggcggcaggatggcggacaagaaaaagccgctccggcgggaaccgtgagcggcttcggacgggcaggccgtcagggtactgcagtgtggttcagtgaaagtgcggctgggcgggtgatgcgtcttccggcatttccgcgtggacgatttcgccgagcggatctgcgtaaagcggtacgccgcagtcgtcgcagtattcgggttcgaagcggcccgcgtgccgccggacgtcggttacaccgcattccttcagcaggctcacgatttcctcgagcggtccttcgatcggcgcttcgccttcgagcgtcgcgctgtcgatcgacacgtcgccgttttcacggccgtaaagcggccatacgacaccgtagattacgtcgttgctggcacgccgcgtgaagccgacacgatactcgtcgatacggcgttcgccgaagccggcgaccaccgcgcgcagctcttgcggtgccgcaccaagtgtgtcgaaaagataacgaatggcggttcgcaccgtgtgcggacgcacccgttcgtccgcatcccggcaagccgaatagtacgcgtccggaagcaggcattcgaattcgcagccgggcagggcgatcgacaggttcgggccgccctgggccgtccattgctcgaggcactggccacgctcgatccggctgccgttttcctcttcctgccatcggaacagcggcgcgccggcgggtgcggcgacgacggcgagcaggaagcgcgggtcggccaggatcggcgaggtttcaggcaggtcgccgaagctgagcttgggggtgtgctgggtgatcgctgcatgagcgagctgctgggctagccggtaggtctcgacgtggtgccgcggcaactggtcaatgctgtaaaggaacggtgccaggccgacgagggtgccgttcgcaaggacgtgtgcctgcaggtgcgttcgcagcgcgtcggcaacgtcactcttgagcgggccggacggaatcatgtagcgcgtccatgcgagaaccgggacggcgaccagcagcgcgtcgaacggttggccgtcgtgctcgatcaccatcgactcgctgtgcgtctcggccatgtcggcgagcgcgccataggcgtcgggatgattctgctgaaggtggtcgagcgctgcgtcgagcgtggtctggttgccgttgcggacaatcttggcgagcagcgcgtcgagcttcgcttcccagaagcgatcctcgatgcggctgcccgacgcgaagagcgcaagcgacagaccgaccagtttgtcggcatcgggggaggcgtttggcgattcgctggcgcatattaaagacgtatatagaaagaggcgaagaacctcacattctagtccgttctttgcaccataagcggtctcgtgccaaggcatggcagatcggccggattgcagcctttgtaaaaagttgcgtcaaaccccttgcgcagttcgaagagggtgcttagaatcacgcctctttcgcgctaacggaaacgcggcgcggaagagggaagcgaagctggtggtgtgctgcagtgtcgggcgcgcggctggcctggaagttgagccccgcagtcgcaacgatgtagtgtaaaaagttgttgacgagctgcgaaacacggttcataatctcgcttctctgctgctgaaaacgcagcgctgccggaaacacgaagttcctcgcagattgctctttaaaaattaacagccgataagtgtgggcgcttgatggaagcgagctgatcttcgggtcagatagcaaaagtatcaagagtctcacactaaagtaagtcaggtttatgaagtgattcatattcctgtcagctttgagtgagcgaccggttcttaaccgaaccgaaaacagtaacaggtttaaactgaagagtttgatcctggctcagattgaacgctggcggcatgccttacacatgcaagtcgaacggcagcacgggtgcttgcacctggtggcgagtggcgaacgggtgagtaatacatcggaacatgtcctgtagtggggatagcccggcgaaagccggattaataccgcatacgatctacggatgaaagcggggaccttcgggcctcgcgctatagggttggccgatggctgattagctagttggtggggtaaaggcctaccaaggcgacgatcagtagctggtctgagaggacgaccagccacactgggactgagacacggcccagactcctacgggaggcagcagtggggaattttggacaatgggcgaaagcctgatccagcaatgccgcgtgtgtgaagaaggccttcgggttgtaaagcacttttgtccggaaagaaatccttggctctaatacagtcggggatgacggtaccggaagaataagcaccggctaactacgtgccagcagccgcggtaatacgtagggtgcaagcgttaatcggaattactgggcgtaaagcgtgcgcaggcggtttgctaagaccgatgtgaaatccccggctcaacctgggaactgcattggtgactggcaggctagagtatggcagagggggtagaattccacgtgtagcagtgaaatgcgtagagatgtggaggaataccgatggcgaaggcagcccctgggccaatactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatggtcggaatcctgctgagaggtgggagtgctcgaaagagaaccggcgcacaggtgctgcatggctgtcgtcagctcgtgtcgtgagatgttgggttaagtcccgcaacgagcgcaacccttgtccttagttgctacgcaagagcactctaaggagactgccggtgacaaaccggaggaaggtggggatgacgtcaagtcctcatggcccttatgggtagggcttcacacgtcatacaatggtcggaacagagggttgccaacccgcgaggggagctaatcccagaaaaccgatcgtagtccggattgcactctgcaactcgagtgcatgaagctggaatcgctagtaatcgcggatcagcatgccgcggtgaatacgttcccgggtcttgtacacaccgcccgtcacaccatgggagtgggttttaccagaagtggctagtctaaccgcaaggaggacggtcaccacggtaggattcatgactggggtgaagtcgtaacaaggtagccgtatcggaaggtgcggctggatcacctcctttccagagcttctcgcaaaattgagcgctcacgcttatcggctgtaaattaaagacagactcaggggtctgtagctcagtcggttagagcaccgtcttgataaggcgggggtcgttggttcgaatccaaccagacccaccattgtctggcggtaacacctgagggtatctgtactcaatgggggcatagctcagctgggagagcacctgctttgcaagcaggggtcgtcggttcgatcccgtctgcctccaccaatcaccaacgctaagtgcttggttcatacgatgaaccgagaattttgcattggcgattgagccagtcagagcggtacgaaagtatcggctgtcgttctttaacaatctggaagaagtaagtaatttggatagcggaagcgtcttgagatggacgtgaaaactatccgggttgtgattgtatcgatgtatctcaagatgattcgaactctaagtttgactcaattggaatacggcacaacgcgagaactcaacctgtagcgactgtcgatgagacagactcgttatagggtcaagcgaacaagtgcatgtggtggatgccttggcgatcacaggcgatgaaggacgcggtagcctgcgaaaagctacggggagctggcaaacgagctttgatccgtagatgtccgaatggggaaacccactccttttggagtatccatggctgaatacataggccatgtgaagcgaacgcggtgaactgaaacatctaagtaaccgcaggaaaagaaatcaaccgagattcccaaagtagtggcgagcgaaatgggatgagccttgcactctttatttgtattgttagccgaacgctctggaaagtgcggccatagcaggtgatagccctgtaggcgaaaacagtatgaaagaactaggtgtgcgacaagtagggcgggacacgtgaaatcctgtctgaagatggggaccatcctccaaggctaaatactcgtgatcgaccgatagtgaaccagtaccgtgagggaaaggcgaaaagaaccccgggagggtgaaatagatcctgaaaccgcatgcatacaaacagtcggagcctcgtaaggggtgacggcgtacctttgtataatgggtcagcgacttacgttcagtagcaagcttaaccgtatagggcaggcgtagcgaaagcgagtccgaatagggcgttcagttgctgggcgtagacccgaaaccaggtgatctatccatggccaggatgaaggtgcggtaacacgtactggaggtccgaacccactaacgttgaaaagttaggggatgagctgtggataggggtgaaaggctaaacaaacctggaaatagctggttctctccgaaaactatttaggtagtgcctcgtgtctcaccttcggggtagagcactgtcatggttgggggtctattgcagattaccccgccatagcaaactccgaataccgaagagtgcaatcacgggagacagacatcgggtgctaacgtccggtgtcaagaggaaacaacccagaccgccagctaaggtccccaaatatagctaagtgggaaacgaagtgggaaggctaaaacagtcaggaggttggcttagaagcagccaccctttaaagaaagcgtaatagctcactgatcgagtcgtcctgcgcggaagatgtaacggggctaagctatataccgaagctgcggatgcgtgcttagcacgcatggtaggagagcgttccgtaagcctgcgaaggtgccttgtaaagggtgctggaggtatcggaagtgcgaatgctgacatgagtagcgataaaggggtgaaaggccccctcgccgtaagcccaaggtttcctacgcaacgttcatcggcgtagggtgagtcggcccctaaggcgaggcagaaatgcgtagctgatgggaagcaggtcaatattcctgcaccattgttagatgcgatgggggacggatcgcggaaggttgtccgggtgttggaagtcccggtcgctgcattggagaaggcacttaggcaaatccgggtgcgcaattcaagggtgtggcgcgagcttcttcggaagcgaagcaattggaagtggttccaagaaaagcctctaagcttcagtctaatgatgaccgtaccgcaaaccgacacaggtgggcgagatgagtattctaaggcgcttgagagaactcgggagaaggaactcggcaaattggtaccgtaacttcgggataaggtacgcccttgtagcttgactggcctgcgccaggagggtgaaggggttgcaataaactggtggctgcgactgtttaataaaaacacagcactctgcaaacacgaaagtggacgtatagggtgtgacgcctgcccggtgccggaagattaaatgatggggtgcaagctcttgattgaagtcccggtaaacggcggccgtaactataacggtcctaaggtagcgaaattccttgtcgggtaagttccgacctgcacgaatggcgtaacgatggccacactgtctcctcccgagactcagcgaagttgaagtgtttgtgatgatgcaatctacccgcggctagacggaaagaccccatgaacctttactgtagctttgcattggactttgaaccgatctgtgtaggataggtgggaggctatgaaaccggaacgctagtttcggtggagccgtccttgaaataccaccctggtttgtttgaggttctaaccttggcccgtgatccgggtcggggacagtgcatggtaggcagtttgactggggcggtctcctcccaaagcgtaacggaggagtacgaaggtacgctaggtacggtcggaaatcgtgctgatagtgcaatggcataagcgtgcttaactgcgagaccgacaagtcgagcaggtgcgaaagcaggtcatagtgatccggtggttctgtatggaagggccatcgctcaacggataaaaggtactctggggataacaggctgataccgcccaagagttcatatcgacggcggtgtttggcacctcgatgtcggctcatctcatcctggggctgtagccggtcccaagggtatggctgttcgccatttaaagaggtacgtgagctgggtttaaaacgtcgtgagacagtttggtccctatctgccgtgggcgttggatatttgaaggggctgctcctagtacgagaggaccggagtggacgaacctctggtgtaccggttgtcacgccagtggcatcgccgggtagctatgttcggaagagataaccgctgaaagcatctaagcgggaaactcgccttaagatgagatatccctggggactagatccccttgaagggtcgttcgagaccaggacgttgataggtcaggtgtgtaagcgcagtaatgcgttcagctaactgatactaattgcccgtaaggcttgatcctataacaagtctgccttgtagatcggcgccgtgcgacagcaccggccgcaagatccagagcgacaagttggattctcgtgtgtgatacacacaacctaattactgcttcttccaagattggttctgttggccacgccagcaggacaaccctctttgcctgatgaccatagcgagtcggtcccaccccttcccatcccgaacaggaccgtgaaacgactctacgccgatgatagtgcggattcccgtgtgaaagtaggtaatcgtcaggctcctaagccagaaaccccgcccgaaaggcgggggtttttgcatttcggcgacgaaaatatatctgcgtttggagaaagggcacgttattcatcccctctacctggcgcgccggcccgatcactcagctgcaatcctgcagtcaaaccctgccccgaaacgaaaccacgcgatttgatacgatcgaagcggcgccggcgattgcactcgtcgacgttcatgttcgaaaccagggcttgatggagagggcgggaatgaatatcggcgacgcgtcgcgcgaatccgagtcagcgcaaaaatgatccggtactacgaacaggttggcctgcttgcgccgagcaaacgtaccgacgccggctaccggatctacggcgcggacgaaattcatatcctgcgcttcatccgtcaggcgcgacgcctaggctttctcgtcgaggacatccgcaagctgctaacgctctggcaagatcgttcccgcgcgagctcagaagtgaagtcgatcgcgctcgagcacgtggccgaactcgacaagcgcatcgcggaactgagcgacatgcgcgacacgctggccgatcttgctgcgcactgtcatggtgatgggcgtccagaatgcccgattttggcgcgtctatccgaccccgtcagtgaaccaaattagtgcgcgtactcgaggctcaagacgggcctcgaatcgatttccataaaaatcaatatgttacgtgaaattgacgttcggccattccaaacaggaatggcttccatgcaagtatttcactagcatcttggtgcggcatcgctataattcgggataaccctatacgggaaatccctgaatctcgattcaccaggggtcccccttccttggagaacgtcatgatcgcctacatcgttgaaaagctgagcaactggttcgaatccgcagaacgtgaacgccgtgaggcttacctcgccacgtcgtcggacatcgtccagctcgaaagccgtatccgctcgctcgaaaccaacggctactcgctgtaatcggagtcaccgtcaggtgccacgtggcaccgaacgataagcaagccccgtattgacggggctttgttttgtgcgccggatctggcgcaatcatcagtgcagcgctatggtatgggcctgcttttcatcccgaaggacacgatcatgcgtttgcgtctcgatgtgcgtcgcagtacccgcgcgcgtctcgttttcggcgcggtggcgcttgttcacggactcgcggccgctgccgcgacgtcgtccaaaccgctgattctcgatacgcaacgcggcatccaggatggcaagggcgggttggtgctgcagacagcgccgttgtctcccgagccgatcgtcgagccggcaggcatgcgggttccggccgggcaggcgccgaacacgtcggttccgctgttcgtcgcgccgtatatcaatgtacccgcgtggggtgggcagccggccaaccagccaaggctcgcgcccagaccgcagccgtaacgcgcagtcgcgtgatcagtttccgcggtgctcgatctggcagcgggcgccgctatcctgtcccagcatctcgaccagatagggcagtgcctcgttcatgctctgggcgagggtgtacggcggattcaggatgaacatcccgctgccgtagagaccgagcccgtcagtgggcggattcgacaccgtcagtgtcaggtgcagccagttgttcggttgcaggcgcttcaactgctcgggaaagcgctgcgattccgttcgggtcacctgcgggtaccagacggcatagcagcccgtcgcgaaacgcttcagacactccgtcacgcaagtcaccgtgcgcgcgtaatccttcttgtcctcgtaggacgggtcgatcagcacgagagcgcgtcgcggcggcggcggcagcagcgccttgatgccttcgaagccgtctccggcaaagatcatcgcgcgtcgccccgcatcgcggaaattgtggcgcagcacgtcgatttccgtcgtgtgcaattcgaacagccgcatccggtcctgctcgcgcatcgatcgccatgcgatgtacggggaccccgggtagaagcgcagttcgccgtcgtcgttcagcgcgcggacttcatccacatagtcgcccagcgcttccggcaggttcttttcgttccacaaccggccgatgccggtgtcgaattccgacgtctttgccgcgtaaccgtcgcgcagcgagtacacgccggcacctgcatgtgtgtcgatgtaccagtacgacttgtctttcttgttcaggtagcgcagcagctggacgacgacggcgtgcttgagcacgtccgcgtggttgcctgcgtgaaaaccgtgacgataactgagcatggcgggctgcctgaaacgaaaggtgaatcgatgaaagcggtcgatcgggcgcggccgtcaggccgggcgccgatgcgggccgcgtattgtacgcgagtggccgtgcatcgcctcattcgtacgcatcgccgaccacctcttcgatgcgttgtttcacatccggtgtcagcttcgaggcaacgtcgagcgcgcgcatgttgtcgccgatctgctcgatccgcgacgcgcccgtgatgaccgagctcacgtgaggattcgcgagcacccacgcgatcgcgagctggccggtgctgcagccgagctccgtcgcaattccgccgagccgttcgacgatgtcgttggcggcctggtcggtcaggcggtcgcgcatccagtcgtacccctgtaactgcgcgcggctgccgggtggtacgccgttacggtacttgccggtgagcaggcccgatgccagcgggctccaggtcgtgaggccgagaccgtagtcgtcgtagagccgtgcatattccttttcgacccgcgtgcgatggaacaggttgtactgcggctgctcgacaaccggcttgtgcaggtggtgccgttcggcgatatcgcaggcagcacggatctcgtcggcgctccattccgacgtgccccagtacagcgccttgccgcgcacgatcatgtcgctcattgcccagacggtttcctcgatcggcgtgttcggatcggggcggtggcaatagacgagatcgacgtagtcgagctgaagccggcgcagtgagccgtcgatggcgttcagcaggtatttccggttcagcgtgtgatactggttcggcgcttcggcgagccccagaagaacttggtggacacgatatagctgacacgcggccaatcgagggacttgagcgcatgacccatgatttcctcggatttgccgccggcgtacacctcggcgttgtcgaagaaattgacgcccgcgtcgcgtgccgcggcaaggcattcgcgcgcgactcgctggtcgacctggttgccgtacgtcacccacgagccgagcgaaagctcgctgatctgcaggccggagcggcctagccgtcgatagtgcatgcgaatctcctgcgtgacagagccgaccttaagcttagacgttttgcgcgcgaacggcggggccgatcgtgcacaatggcggctggcccgtcgcttcgatcatgcgatgaacgccgaggtgacgggcacgtacttttcgatccgacaacgggaggagacggacatggcagcagatctgaatggcaagaccgcagtcgtcacgggcgccgcgagcggcatcggcaaggaaatcgcactcgagctcgcgaaagcgggcgcggccgtcgcgatcgccgacctgaaccaggacggcgcgaacgccgttgccgacgagatcgtcaaggcgggcggcaaggcgatcggcgtcgcgatggacgtgacgaacgaggaagccgtgaacagcggtatcgacaaggtggccgaaacgttcggctcggtcgacatcctcgtgtcgaacgcgggcatccagatcgtcaacccgatcgagaactactcgttctccgactggaagaagatgcaggcgatccacgtcgacggtgcattcctgacgaccaaggccgcgctcaagcacatgtacaaggacgatcgcggcggtgtcgtgatctacatgggttcggtgcactcgcacgaagcgtcgccgctgaaatcggcgtacgtgacggccaagcacggcctgctcggcctggcccgcgtgctggcgaaggaaggcgcgaagcacaacgtgcgctcgcacgtcgtgtgtccgggcttcgtgcgcacgccgctagtcgacaagcagattccggaacaggcgaaggagctcgggatcagcgaagaggaagtggtgaagaaggtgatgctcggcaatacggtcgacggcgtgttcacgacggtgcaggacgtcgcgcagacggtgctgttcctgtcggcgttcccgagcgccgcgctcacgggccagtcggtcgtcgtcagccacggctggttcatgcagtaaaggcttccggcacgggcggtcgcgacacgtgctgcccgggcgacgattccccggcaagtccggagaatcgcacaaaaacgcgctccgaggagcgcgtttatcgtttcggcaggacggggccggtgatggctgccgtccgttggtgccgacttacttcaggacagctgcaacggcattggcaaccgcgtcgaggttgcgcgtgttcagcgcggcgacgcagatccggcccgtgccgaccgcgtagatgccgaactcgtcgcgcaggcgatcgacttgcgccgaggtcaggcccgaatacgagaacatcccgcgctgcgcgttgatgaagctgaagtcgcgatcgacgccgcttgccttcaggcgctcgacgagaccgttgcgcatcgcgcggatgcggtcgcgcatttcaccgagttcctgcacccacgaagcgtgcagttccggcgatgcgagcaccgctgcgaccacggcgccgccatgggtcggcgggttcgagtagttcgtgcggatcacgcgcttcagttgcgacagcacgcgcgtcgcttcttccttgctcgacgtgatgatcgacagggcgccgacgcgttcgccgtacagcgagaacgacttcgagaacgacgacgacacgaatgcgttcaggtcggccgcggcaaacaggcgcacggcggcagcgtcggcctcgatgttctcgccgaagccctggtaggccatgtcgaggaacggcacgaggttgcgtgccttcacgacgtcgacgacctgttgccattgcgcttcggtcaggtccacgccggtcgggttgtggcagcatgcgtgcagcacgacgaccgtgccggcttcgtagccgttcagcgccgacagcatgccttcgaagttcacgccgttggtggccgcgtcgtaatacgggtacgcaacgacttcgaagccggccgcttcgaacagcgcgcggtggttttcccagctcggatcgctgatcgcgaccttcacgttcgggttcacggtgcgcaggaaatcggcgccgatcttcagcgcgcccgtgccgcccagtgcctgggccgtgaccacgcggcccgctgcgatcagcggcgaatcgttgccgagcagcagcttctgtacggccgcatcgtaggcggcgatgccgtcgatcggcaggtagccgcgcggcaggcccgcttcaacgcgcaccttctctgcttcgcgaaccgcgcgcagcagcggatcttgccttcttcgttcgtgtacacaccgacgccgaggttgaccttggtcggacgcggatcggcgttgaaggcttcgttcaggcccaggatcgggtcgcggggagcaagctggacagcagagaagagcgacatgatgattcggcagtagtgaaaagagggtcaggctttcaacgggcggggcgggcgcggggaccgcgcgcaggcaggcacgacgccggaaagcgcagcagcctgacattgtagcgaattcgcgctggcgggggcggcgtttcggcggcgaaattcggccgggaaccgcgattcctggcagccgtcgcgcgtcaggagccgacagcagttcgcccggccgcgaagcgctagaatgactctttgccctcgctccggccgcattccatgtccgaacatcatgccgaaaccggcgacgcgctcgacgaatcgaaattcgtgaccttcgaagggtcgccgttccagctgtaccaaccgtatccgcccgcaggcgaccagccgaccgcgatcgacacgctcgtggaaggggtcgaggacggcctgtcgttccagacgctgctcggcgtgacgggctcgggcaagaccttcacgatggcgaacacgatcgcgcggctcggccgcccggcgatcgtgttcgcgccgaacaagacgcttgccgcgcaactctactcggaattccgggagttcttcccgcgcaacgcggtcgagtatttcgtctcttactacgactattaccagcctgaagcctacgtgccgcagcgcgacctgttcatcgagaaggactcgtcgatcaacgagcacatcgagcagatgcggctgtcggcgacgaagagcctgatggagcgccgcgacgtcgtgatcgtcgcgacggtgtcggcgatctacggtatcggcaatccgtccgaataccaccagatgatcctgacgctgcgcgccggcgacaagctcggccagcgcgacgtgatcgcgcggctgatcgcgatgcagtacacgcgcaacgagcaggatttccagcgcggcacgttccgcgtgcgcggcgacacgatcgacatctttccggccgagcacgccgagctggccgtgcgcgtcgagctgttcgacgacgaggtcgagacgctgcagctgttcgacccgctgaccggtcgcgtgcggcagaagatcccgcgcttcaccgtgtatccgtcgtcgcactacgtgacgccgcgcgataccgtgatgcgtgcggtcgagacgatcaaggacgaactgcgcgagcggctcgagttctttcacagcgacggcaagctcgtcgaggcgcagcgcctcgaacagcgcacgcgtttcgatctcgagatgctgcaggagctcggcttctgcaagggcatcgagaactactcgcggcatttctcggggcggagcccggcgatccccgccgacgctcgtcgactacctgccgcccgacgcgctgatgctgctcgacgaatcgcacgtgctgatcggccagctgaacggcatgtacaacggcgaccgcgcgcgcaaggaaaacctcgtcaactatgggttccggctgccgtcggcgctggacaaccggccgctcaagttccccgagttcgagcgcaagatgcgccaggtcgtgttcgtgtcggccacgccggccgactacgagaagcgcgtgaccgggcagatcgccgaacaggtcgtgcggccgacggggctcgtcgatccggaaatcgaagtgcgaccggcgagctcgcaggtcgacgacgtgctcgccgagatcaacgcgcgcgtgaaagccgaggagcgcgtgctgatcaccgtgctgacgaagcgcatggccgaacagctcactgagttcctggccgaccacggggtcaaggtgcgttacctgcacagcgacatcgacacggtcgagcgtgtcgaaatcatccgtgacctgcggctcggcacgttcgacgtgctggtcgggatcaacctgctgcgcgaagggctcgacattcccgaggtgtcgctggtcgcgatcctcgacgcggacaaggaaggcttcctgcgcgcggaacgctcgctgatccagacgatcggccgggccgcgcggaacgtgaacggcaaggcgatcctctacgcggacaacatgaccgagtcgatgaagcgcgcgatcggcgagaccgagcggcgccgcgcgaagcagattgcctacaacgagcagatgggcatcacgccgcgcggtgtcgtgaagcgcatcaaggacatcatcgacggcgtctacaacgcggacgaggcacgcgccgagctgaaggaagcccagcagcgtgcgaaattcgaggacatgtcggaaaagcagctcgccaaggaaatcaagcgcctcgagaagcagatggccgactacgcgaagaacctcgagttcgagaaggctgccgcgacccgcgaccagcttgcgctgctgcgtgagcgtgtgttcggcgcgaacgtcggcgatcacgtcaacggcggccggtaaatctttccaagcgtcactgaaaccttgcggtaacgagcctgtaagccttgtcggatcaggggtttacatggctcgtcgtttgttccggaacaggttcggtgctaaacttcgcaattattgagaattgttcgcattaacgttattcgtcgcgttagtgttttcggcgggcaggcctgacggtcggtccgcatggttccagatcaaataacaaggagtgtccatgttgggttcttcgttcatccgcacgacggttgcggtagcggcggcgcttgccgcgatgtcggcctcggctgccgaatatccgatcggcaagcagcagatccagggcggcatggaaatcggcgcggtgtacctgcagccgatcacgatggacccggaagggatgatgcgcaaggcgtcggattccgacatccacctcgaggccgacatccatgcggtcaagaacaacccgacgggtttcgcggaaggcgactggatgccgtacctgcaggtcacgtacaagctgacgaagcagggcgacacgaagtggaaggccgaaggcgacctgatgggcatggtcgcgagcgatggtccgcactacggcgacaacgtgaagctgaacggcccgggcaagtaccacctgacgatggtcgtcaagccgccgatgcagacgggccacatggctttcggtcgtcacatcgacaaggaaacgggcgtgggcgcatggttcaagcccattaccctcgaatacgacttcccgttcgccggtatcggcaagaagggcggttactgattggtggcatcacggacggcgcgcttcggcgcgccgtcggcgtagagaacccagaatgaaaaatccccagaaaatcgtcgccgcagccgctgcgttgtggcttgccggcgcagcgtacgctgccgatctgccgacgttcaagctcgaaatggcggacggcaagctgaatcccgcccgcatcgaagtgccggccggccagcgtttcaagatcgagatcaagaacaccggcaaaggcgcagccgaattcgagagcgtccagctgcgcaaggagaaggtgcttgcgccgggtgccgattcgttcgtggtcgtcgcgccgctgtcgccgggcgaatacaagtttttcgacgatttccaccagcaggcgcagggcgtgatcgtcgcgaagtaacacgttttatctgcgcgcaggctcaccagcccggtgttctgcgcgtcaggaggtatcgatgggtcagatcttgttcatcgtctggcgggagagcgtcgaagcgctgctcgtcgtcggcattctctatgcatggctgaaaaacggcgacgacgacgcgcgccgcggcctgcctttcctgtgggccggcgtcggtgtcggcttgctgatggccgtgggcctcggcgccgcgctggtcggtttcaccgaagtgctgtccggtgacgcgcaggactacttccagactgcgatggtgctgatcgcatgcgtgctgatcgtgcagatggtgctgtggatgcgccggcacggccgcacgctgaagcgcgacatggagcaatcgcttcagcagagcacgcgcgattcgaactggtggggcgtcgcggtgctggtcgcgcttgcgatcgcgcgcgagggcagcgagacggtgatcttcctgtacggtctcggtttcggccagtcgggccacgtcgacggcagccagatgctcgcggtcgtgatcggcctcggccttgcgttcttcacgttctatctgctgcagctcggcggcaagtacttctcgtggcggcatttcttccgcgtcaccgaagtgatgctgctgttcctcggcgcaggcctgttccagaccggcgtcgacaagctgatcgacaaggaaatcctgccgctcggcatttcgcaggtgtgggacacgtccgcgatcctcgatgattcgggcacgttcggctcgctcgtcgcgacgctgaccggttatcgcgcgcacccggcactgaccaacctggttgcgtacgcggtgtactgggcggtggtctggttgctgatgaagcgtgcgagccgtcgcccggccgtcgctgcgggtcgcgcggcatgagcgttgccgccgcagccaagccgggctggctcgcgcaggcgggccagtggatgcagcgccacggcgcgctgatccgcggcatccagtgggccgtcgtcgccgtctatgcattcctgatcatcgtgccggcggtgttgccgctgccggacgactctgcgcacctgtggagcaacctcacgctgatcgcgcaattcacgttctggggcatctggtggccgttcgtgctgctgtcgatggtgatgctcggccgtgtctggtgcggcgtgctgtgtccggagggcgcgctcaccgaattcgcgagcaagttcggccggggcggtccgattccgcgctggatacggtggggtggctggccgttcgtcgcgttcggactcacgacgatctacgggcagatggtgagcgtgtaccagtatccgctcgcggtgctgttcgtgctcggcggctcgaccgtcggcgcgatcgtgatcggcgtgctgtacggccgcgagaaacgcgtgtggtgcaagtacctgtgcccggtcaacggcgtgttcgggctgctcgcgcggcttgcgccgatgcgctacaaggtcgacgaggaggcatggcgtcgttcgtacaagaacggcgagcatggccatcgcgtgattccgatcaactgcgcaccgctcgtgccgttgcgcaacatgcagggcgcggcggactgccatatgtgcggccgctgcagcgggcaccgggatgcgatttcgctgtcgtcgcgctcgccgtccgacgaagtcgtgaacctcggcgcgcaaaggcgaacccgtgggacaccgcgctgatcctgtacggcctgctcggcgtcgcgatcggtgcgttccactggaccgtcagcccatggttcgtgcagatcaagcaatggctcgcgggctggctgatcgaccatgacatcacgtggccgctcgaaaccaatgcaccgtggttcctgctcacgcattatccggatcgcaacgacgtattctcctggctcgacggcgggctggtcgtcagctacatcgtcggcacggggctcgtgtacggcacggcgctgctggtgctgttggccggcgccacgctgatgctcggccgcttcgagcgtgtgcggctccatcatctcgcgcaggctttgatcccgatcgcgggcgcgggcgtgtttcttggcctgtcggccacgacgctgtcgctgcttcgtgccgagcatgtgccgctcggttgggcaaccgatgtacgcatcgcgatcctggtcggcgccaacgcatggagtgcgtggctcgcatggaaagtgacggggcgttatgcggccttgccgcgccggcttgcggccttcgcgtggttcgctgtcgcgcttgccgtcatcgacagcgcatggtggctgatgttctggggtttctgaagcggctcgcgcgccgcttcggcggtcatgcacttacgcggtaacgaatctcggggacctgcttcgcgcattggccgcccaaataaaaagcgacacgtcgaaggacgtgtcgctttcttcttccttgtgcgagaaccaaaaagtggcttggcttgctgcaacggctgcttgagtgtgtttgcacgaaggggtctagatctcgcgtgcaagccgttacgctggctaatgcccaacacctctcagggaggtggtccccacaatactctgtcgttacttcgtcaggatcagtttgccgagccgtgtggcgcgcaactgataggtctctccgttatgcgcgatgctgacgtggctttggccttgcagcagcgcatcgctgctgacgacccgcgtgcctgcatcgcggttgccggcgggcttcgccggcgtggtgaccgctgccgtcttctggcggctgctgcctgcggtgccggtcgggcggcgcaaggtcagcgtggtcgggcgcatggtgtcggtcattcggttgatcggtgactgtcgatacgatggaatgaattctaaatgataactattcccatttacaaaaactctttatcgatcggaatggtgaatctgatagcttgaatcaaaggggcggcccgcaggccgccgccggtttcagtgcagcggatcggggtccttgcggccctgcgcgtactcgcggatcaggcggaccgtgtcgatatccgacgtgcggtacgcctccttgacgatcccgtgcgtctggcgcgcgtcttcgctgtcatcggtgacgaccagcgtcgtgcggtattcgaaacgcaggaacagctcgtggtcgtcacgttcctcgatcgtcatcgtcagcgagccgccgatctcgccgtcggcggcgcggatgtcgtagcggacctgctgattcggcgtgaacgtgacgtggtcgcgcacggtcgcgtgaccgtagtgcagttcacgttcgagcgtcgtctccgtccgttcgtggacgacgcagctgtcgagaccgagcacgaacagttgcggctgttcggcgcgcagcacgagaccttcccagagctggtcgcgggtgagggtgggcacggccggatcgtcggagttgatctggatcagatgttcgaagttcaaggggacgggttccttctggtggcgggcggccacatggctcaagaagtcattgtgacgcaaaacgggcggtttcgcggcacctgcccgtgcgtccacgcctcatgcctcgatacggcccatgcgccccgtctggtagtcgacgaccgcctgccggatctcttcctcggtattcatcacgaacgggccgtagcggacgatcggctcgttgagcggtacgccgccgatcagcagcaggtcgagcggcgtgtcgccggcagcgaacgtgaccgtgtcgccgtcgtcgccatacacgaccatgtgccgtgcgtcgactgcctgcctgtcgggcccgtagaggcccgttccgtcgatcggataggcgaatacacgatagcctgccgggacgggctgcgtgaccgttgcaccgggttgcagcgtgaaatgctggtagaggatcggcgtgcgcgtctcgatcgccgcccggacgccgaacgcttcgccggcgatgacgcgcacgcgcgcgagaccgtccggcgacgtggcgctcgggatgcgatcggccgggatttcctggtagcgcggcgcgatcagcttgtcgcgccgcggcaggttgacccacagctggaagccgtgggagcggccgcctgcctgcgcgaattcaggatccggcatctcgctgtgcacgacgccggcgcccgccgtcatccattgcacgtcgcccgggccgagcgtgccggcatggccggacgagtcgcgatgacggaagcgcccgtcgagtgcataggtcacggtctcgaagccgcgatgcggatggtcggggcgcccttggcttcgccgggcgcgtagtcgacggggcccatttcgtcgagcagcaggaacggatcgaaatccatcagcagccgggtcgggaacgggcggtgaaccacgaagccgccgccttcggtcgtgcgaagtgcggggtacgtgcggtcaagcgagcgagcggtcgtcatgcggataccctcgaaatcatcggaatagcgttatttttgaaacatagcgctattatattgggcgttttaccgcgcgattcgcgacggttcgcaatggattgttctgaaattggaacgatgagatgaatatcgatgcacacaacctgaacgacctcatgtacttttcgcaggtcgtcgaacatggcggtttctcggccgcggagcgcgtgctgggcatctcgaaatcgcgcctgtcgcggcgcctgaccgaactcgaggcggcgctcggcgtgcgcctgctgcagcgctccacacgcaagctcgcgctgaccgaggcgggggagctgttctaccagcactgccaggcgatgctggccgaagcgcaggctgcaatgaacgcggtccagcagttgcgcgcatcgccgcgcggctcggtgcgtgtcagtgtgcccgtgacgctgtcgcagacgatgctgtcgcgcatcctgcccgaattcctgcgccgctatcccgaggtgaaggtgcacgtccgcgtgacgaatcgcgtgatcgacctgttcgaggattcgatcgacgtcgcgctgcgtgtgcgctcggagccgccgcagaacgcgaatatcgtcgtgcggccgctgtggcgcaccgagcagatgctggtcggcgcgccgagcctgctgagccagaatgcgccgccgctggtcccggacgacctgagcggattcgaaacgctcgatacgccgagcgtcgacgggcggcacgtgttcaacctgatcgcgccggacggtacgcgtcacgtgcacgaacacgacccgcggctggtgacggccgacctgatgacgatccgcgaagccgtgctcgatggcctcggcatcgcggcgctgccggagatgatgtacggcaacgcgctgcgcgcggggcaactgtcgccggtgatgccgggctggacgctgcccgtgccgcaactgtacgcggtgttcgtgtcgcggcaggggatgccgcctgcggtgcgtgcgtttgtcgactatctggtcgagaagctcgatcacggcgcctacaaggaaccggggtgtccggagcgtgcgaagaaggaagcggcggccgatgtttcggcgacctgaacacgacgtgcacggcgaggcaaatttgttttgtcattgaagcgtcgcctgcaatcgcaagtttcaatcgccggaaccttgaatgcgcgtgcgtgcgagcctatattgaaatcccatttcgtgaaggaagttctgagcgaaatcaggtggccgcatatattgtgagccagatagggcagaacgcgcagtccgtgcagaccacggcagagtcgcatttgcgttgctcgaggcgtaaccgataccgccaaagagcccgccgcccgaaggcgcccgcgtgcgcatgaaaaaggccttcatctggcgatgaaggccttttactttgtgtgcggccggcgaggtgcggccggccaggtgcagccggtgagcgcccgattgcgcgtgcgttacttcgcttttgcggtcggctcggtcacgaagccgagcttcgtcaaaccgccggcctgcgcatccgacatcacttcggcgacgtgttcgtaggcaaccttgcggtccgcacgcaggtgcaactccggctgcggcgtgcgttttgccgcttccgcgatgcgttcctgcaattgttcgcgcgtgaccgtatggtcgtcccacaggatcgtgccgtcgccctggatcgcgacgtcgaccgtctgcggtttctcgtcgacaggctggctgctggcatgcggcaggtcgatcttcaccgcgtgctgcatcgccgggatcgtcacgaggaaaatgatcaggagtacgagcatgacgtcaacgagcggcgtcatgttgatctcgctcatcactgcatcgtcgtcatcgtcgctgaaaccggtgttcattgccatggttcaccccgtctcagctggcgcgcgtcgcgaggcgcaggccgtcgcgcgtcgacgacgatgcgaggctcgcgcccgtcacgaaatacgcgtgcaggccgtgcgcgaagcggcgcagcttgctgacgacgcccttgttcgcacgggtgagtgcgttgtagccgagcacggccgggatcgcgacgaacaggccgaatgcggtcatgatcagcgattcgccgaccgggcccgcgacctggtcgatcgacgtctggccggatgcgccgatcgcgagcagtgcgtggtagatccccagaccgtaccgaacaggccgacgaacggcgccgtgctgccgaccgacgcgaggatcgcgaggccgctttgcatgcgtgagatgccttcgtccatcgtgtccttcaggcagcgcgtgacccagtccgacacgtccatgcggtcgtgcaggtgcggttgcgtctggtggtggtgatcggcggcttccttgcccgacagcgcgagcgcgaggaacgggttgtcgttcggcgtcgaggcggcgagcccgagcttcttgatgccgtcgtcgaagttgtccgaatgccagaacgcctgctcggcgttcttcgtcaggcggttcaggcggatcacgttccagcccttgatgacgatcacgatccacgacaggaccgacatcacgagcagcgtgatcgcgatggcgcgcgtgacgaaatcaccttgcgcccagacgtgcgcgataccgtagctttgcattttcttgtttcctttgaatctaccgaatatgacgggttagtcgtcgagcgtgaagttgaagggcagcgtatgggcggcgcggatcgcctggccgttctcgatatacggcgggcaggtgctggcgcgcgttgcctcgagcgcggcttcgtcgagacgcgggtagccgctgctcttctgcagctggacgctttcgatcttgcccgtcacgccgatgatgaagtggacataagccgtgcccgtttcgccgcgacgcttcgacatcgtcggataggcaggcttcacgaaattgcagctgagcgccgtgacgttcttcggtgcgctgacctgcatcgtctcgcgcgccgggccgggtgctgcagccggtgcggcaggcgccggcgcggcgggagccggcgtcggatcgaccactgccggcgcgggcgtcggcgacggtgcctgcgcgaccggctgaggcgtcgggacggctttctgtaccggcttcggctcgaccttcggcttcacgcgcggcgtgggcttgggggcgtgggctgctgcgcggccgactggaccgcgaccggctgggcagggggcgcgggcggaatgagctgtgcggtgatcgactgaacctcgatctccttcgccggcggcggcgcgttgcgatggagccaggcggccgtcagcatgatcgcatgtgctgcaagcacaccgaccgcggcgacgatcactcggggattcatacgtggtgcagccggcaagatgctggcgggagtggaatgcgaagcctgcatgttagcttgaaagaacgatgtcgcacccggggcgcggcgggtgaatcggcatcacttgcggaagatcagcagcgagatgcaaacggtggtcacaaatccgatcagcaattccatgacaggctccttggcaggtaagccgctggctcgcgcatacggtggcttgctgacggtcaaaacaaaaatgcggcctgggccgcatgtacacacccggcgccggtcaggcagccttgcgttcgtagaacgtgaccgggatcggatgagcgtggtgctcgacaccgcactggctcgcgcagacgccttgttcggccatgaggtcgcgtacggactcctcgcacttgccgcagcacgtggccacgccgagctcgaactggagttcatcgaaagagttcacgccctctgcgagggacgcgcgaatcttgcgatcggaaactgacttgcacacgcagacgatcatggtgagttgcgatagctaacgttaatgcgaattattatcattaattttgcggacgttgacaagcgcgggtcgggctttttaaggtcatcggacccttgaaacgatgggggcggtggagcggcacgcggcagcgggcgtgccggcttgtgtcaggcggtcgcgcaggcgcgcgttcggcgaggaaatggtgacggattcgaccggtgcagcgaggccgagcagcgtcgacgcgagtacctgcaactggcggccgtcgctggtcgagcagaagcggggcggcgccgcgcgcgtgccggccggcgcacgcaggctgcgctcgtcgagaatccgggcgagctggcgcgcgattgcgtcgctcgtgtcgacgatcgtcaggcggtcgcccacaaggtcacgaatcgtttccgtgaagaacgggtaatgcgtgcagccgagtaccagcgtatcggcgccgtcgtcgagcatcggctgcaggtagctgtcgagcaacgcgcgcaatgcaggcgaattcgtgtcgccgcgctcgatggcctcgacgagcccgtggccgggctggcagatgaagcggcggccggcgccgtagcggtcgagcagcgcctggaagcgcgggctgttcagcgtcgactgcgtggcgaggacgcccgcgacgccgctcgcggacacggcgacggccggcttgatgcccggctcgacgccgacgagcggcatcggcaggtgttcgcggatcgcggcgatcgcgcgtgcggttgcggtgttgcaggcgatgacgagcgccttcgccccttcgcgggccagccactcgccgattgccagcgtacgttccgtaatgaacgcctcatcgcgcggaccataaggtgcgtggtgcgaatcggcgacgtagatgaacgattcgtcgggcagctgcgcgcgcgcgcgcgcagtaccgacaggccacccagccctgaatcgaagatgccgatgggggcagcggtcgtggacgtcgcggcgataacggaaggtgtcgacatgaaaggacgggtggcgatggcgggaagggcggagcgcgcttactccggcgaacccatcatcgtttgctggtagttctgcaggccgaccttgccgatcaggtcgatctgcgtttccagccagtcgatgtgctcttcggtgtcgtcgaggatcttttcgaagatctcgcgcgacacgtagtcacgaaccgattcgcaataggcgatcgcttccttgcaggtggactgcgagatctgctcgagcttcaggtcgcacttcaggatctcttcggtttcctcgccgatgagcagcttgtgcagatcctgcaggttcggcaggccgtcgagcatgaagacgcgctcgatcagccagtcggcgtgcttcatttcgccgatcgactcgtcgtactcgtgcttgccgagtttctcgaggccccagtgcttgtacatgcgcgcatgcaggaagtactggttgatcgccgtgagttcattcttcaactgggcgttcagatattcgatgactttcttgtcgccttgcatggcttgttccttgttcagtggggcttcagaaaccgaaagataatcgctcgtacgagaaaagccaagcctcgaagccttgccgggcctgccttttgcatgtaatgagaatcagcctcgaataatcggccgcatgcaggaatgagaacgagaagcaaaaggccggacttgcgtccggccttgcattcgatcgcgctcaagcggttgcgaccgggatcttgccgatcttcgcctgccactccttcgggccggtctggtgcaccgacgtgcccgacgaatcgacggcaaccgtcaccggcatgtcctgcacgtcgaactcgtagatcgcttccatgccgaggtcctcgaatgcgagcaccttcgcgccgcggatcgccttcgacacgaggtacgcggcgccgccgacggccatcaggtaggccgccttgtgcttcttgatcgcgtcgatcgcgaccgggccgcgctcggccttgccgaccatcgagatcaggccggtctgcgcgagcatcgtctcggtgaacttgtccatgcgcgtggccgtcgtcgggcctgccgggccgaccacttcgtcgcgcaccggatcgaccgggccgacgtagtagatcacgcggttggtgaagtcgaccggcagcttctcgcccttcgcgagcatgtcggcgatgcgcttgtgcgcagcgtcgcggccggtgagcatcttgcccgacagcagcagcgtctggcccggcgtccagctggcgacttcttccggcgtcagcgtgttcaggtcgacgcgcttgctggtttccgtgttgggttcccactggaccttcggccatgcgtcgagcgacggtgcttcaagcttggccgggcccgagccgtcgagcacgaagtgcgcgtggcgcgtggccgcgcagttcgggatcagcgcgaccggcttcgatgccgcgtgcgtcggtgccgccatgatcttcacgtcgagcaccgttgcgaggccaccgaggccctgggcgccgatgccgagagcgttgaccttctcgtgcagttcgacacgcagttcctcgacccagtccttcgggccgcgcgcgatgatttcctggatgtcgatcggctccatcagcgattccttcgccatcagcatcgccttctcggcggtgccgccgatgccgatcccgagcatgcccggcgggcaccagcccgcgcccatcgtcgggaccgtcttcagcacccagtcgacgatcgagtcggacgggttcagcatcacgaacttcgacttgttctccgagccgccgcccttcgccgcgacctgcacgtcgaccttgtcgcccggcacgatctcgtagtggatcacggccggcgtgttgtccttcgtgttcttgcgggcgccttccggcggattgacgatcgacgcgcgcagcacgttgtccgggtgcgtgtaaccgcggcgcacgccttcgttgatcatgtcggtgaggcccatcgtcgcgccgtcccagcgcacgtccatgccgaccttcacgaagatcgtgacgatgccggtgtcctggcagatcggacgcttgccttccgcgcacatgcggctgttcgtgaggatctgcgcgatcgcatccttcgcggccgggctttcttccagctcgtacgcgcggccgagggcctggatgtagtcgagcgggtggtagtagctgatgtactgcagcgaatccgcgatgctctggatcaggtcttcctgtttgatgacggtcatggctgagactctgtggggacagtggggaatgcgtttatgcgttggcggctgcttcggccggcttgcgggacgcgggcacggcactctcgtgcggcgcgtgcgtctcgtggaaatgggccgggtgcgtgtgcgtcgtcaggcggtcgacccacgccatcacgagcgccgacaccaggaacgacacgtggatgatcacctgccacatgatcgcgtgcatcgtgtgctggtcggggttgatgaacgtcttcagcaggtggatcgacgaaatgctgatcagcgccatcgacagcttgaccttcagcacgcccgcgttcacgtggtcgagccattcgggctcgtcggggtggccctcgatgccgaggcgcgacacgaacgtttcgtaaccgccgacgatcaccatgatcagcaggttcgagatcatcaccacgtcgatcaggccgagcaccgcgagcatcacgctgatttcgtcgaggctggtcgcatgcgacagcaggtgccagacttccttcaggaacaggaacacgtagacggcctgcgcgacgatcaggccgaggtaaagcggaacctggagccagcggctcatgaaaatcagcgcgggaagcgggcgaagcgggcgacgggcggggcggccgggcgaatgcggggcggacatggtggagactcgggcgcggtgcgcaggtatcgggggtaatcttgaaaaggcgcgctattgtaacgcgtcggccggcgcgactgcagtgacgcgccggcacagccagggacggatcaggacgcggcggcgggcacgcgtttcacgcgcaggctcgcgagcacgatgccggtgacgacgcacgcgagcgcaatgccgtgggcgagggtcggccgctcgccgaggaacgcgatgccatacgcggccgcggcgaccggcagcatcgcgctgaacacgcccgcgaggctgcccggcacgtgccggatgcctttcatccacagccagaacgagaagatgctggccgacaggccgtaccagacgacgagcgcccaggtgccggccggcacgctcgcgtaatcgaaatgccacatggccgtcgcgccgagcggcagcatcaggcacaggccgaacaggtgcgtgtacgcgcagatgtcgatcggcgcgagcgtctgcgtgaggcggcgcgacaggatcacgtagatcgattcgcagcacaccgcgccgaggatcagcaggttgccggtcagcgacgacgatgcgccgtgcccggcggcgctgccgttcgcgaggttgatcgtcacgacgccggcgatcgcgagcgcgatcgacacgagcgcacggccgttcggtttttcacgcaggatcagccacgcgaacagcgcgacgatcgccggaatcgtactggtgatcacgccggccgcgaccgcgctcgtgcgctgcacgccgttcagcatcagcagcgtgaacatgaaggtgccgaagaacgcctgcaggaacaggttcagccattcgccgcgcttgacggtgcgcatcttcaccgggctgaacagtggccacagcacggcgatcgcaatcacgaagcgcagcgtggcgaggatggcgacgggaacgaagacgacgatcgatttgccgataccgacattgctgccgacgaacagcatcgacagaacgagaaagaaagcatagcgattcaagctggaatccggaaggcgagttcagttaggattgtagggtcgcgctcgttacagcgtaaagctgcaagcggcgccgcccggcgggcgaaacggccgtgccgcgtaagtgacgggtaagttggagcgcttattgtggacactgtcgggtcgcccggtcgccatcgtgcgacgtggtgcggcgcagcatcgcgcagcggccttcgggccgtgcgcggatggtgggtaggagacagcggcgcgcatgcgccggccaagacgcgcggcgtgcacgatcgcgccgccatgcagaggattcatgttcaccaaggggtagtcgatgtccacgattgaatcggttcttcacgaaacccgccagtttgcgccgcccgcgacgctcgagcaggcggcgaccatttccggcatgccggcctatcgggcgctcgtcgccgaggccgagcgcgattacgaaggcttctgggcgcgcctcgcgcgcgaaggcctcgcgtggcacaagccgttcacgaaagtgctcgacgagtccaacgcaccgttctacaagtggttcgacgacggcgagctcaacgcgtcgtacaactgcctcgaccgtcacgtcgaagccggcaacggcgagcgcgtcgcggtgatcttcgaagccgacgacggcaccgtcacgcgcgtcacctatgcggatctcctcgcccgcgtgtcgcgtttcgcgaatgcgctgaagaagcgcggcatcggcaagggcgaccgcgtcgtcatctatatcccgatgtcgatcgaaggcatcgtcgcgatgcaggcctgcgcgcgcatcggcgcgacccactcggtcgtgttcggcggcttctccgcgaagtcgctgaacgagcggctcgtcgacgtcggcgcgacggcgctgatcacggccgacgagcaggcgcgcggcggcaagacgctgccgctcaagagcatcgccgacgaggcgctcgcgctgggcggctgcgaagcggtgaagagcgtgatcgtctatcgccgcaccggcggcaagatcgactggcatgccgaccgcgacctgtggatgcacgaactgacggccgccgaatccgacacctgcgaaccggaatgggtgagcgccgagcatccgctgttcatcctgtatacgtcgggctcgaccggcaagccgaagggcgtgcagcacagcaccggcggctacctgctgtgggccgcgcagacgatgaagtggaccttcgactggaagcccaccgacgtgttctggtgcacggccgacatcggctgggtcaccggccacacgtacatcacgtacggcccgctcgcctgcggcggcacgcaggtcgtgttcgagggcgtgccgacctggccggacgccggccgcttctggaagatgatcggcgaccacaaggtcagcgtgttctacaccgcgccgaccgcgatccgttcgctgatcaaggccgccgaggccgacgacaaggtgcatccgaagagctacaacctgtcgagcctgcgcatcatcggcacggtcggcgagccgatcaatccggaagcgtggatgtggtatcacaagcacgtcggccaggagcgctgcccgatcgtcgatacgtggtggcagaccgagacgggcggccacatgatcacgccgctgccgggcgcgacgccgaccgtgcccggttcgtgcacgctgccgctgccgggcatcatggccgcggtggtcgacgaaaccggccaggacgtgccgaacgggcaaggcggcattctcgtcgtcaagcgcccgtggcccgcgatgatccgcacgatctggggcgacccggagcgcttcaagaagagctattaccccgaggaactcggcggcacgctctatctcgccggcgacggcaccgtgcgcgacaaggacaccggctacttcacgatcatgggccggatcgacgacgtgctgaacgtgtcgggccaccggctcggcacgatggagatcgaatcggcgctggtctcgcacgagctggtggccgaggcggccgtggtcggccgtcctgacgacacgacgggcgaggcggtggtcgcgttcgtggtgctcaagcgttcgcgtccggaaggcgaagaggccgcggcgctcgcgaagacgctgcgcgactgggtcggcaagcagatcgggccgatcgcgaagccgaaggacatccgcttcggcgacaacctgccgaaaacgcgctcgggcaagatcatgcggcgcctgctgcgttcgctcgccaagggcgaagcgatcacgcaggacacgtccacgctcgagaacccggccatcctcgagcagctcgccgaagtgcgctgaccgtaccggttgcgcatcacgcgcacgagcccctgcgcggcaatcccgattgcccgcgcaggggctttttgttacataacggcatgaccgttccgacccgatccgcgcccgccgcgccaccgcccgttcccgagccgctcgcgcgtgcccacgcacgctactggcgcttcaatgtcgcgctgatcgcggtgctgatggcgatcggtttcgccgtgtcgttcatcgtgccgttcttcgggcccgcgctcgcaagcgtgcgctttgccgggttcagcctgccgttctacgtcggtgcgcagggcgcgattctcgtgtatctcgtgctgatcgtcgcgtatatcgggctgatgcagcgcgccgaccgcacgctgcgccgcgcgtacgacgatcatgcggcgcgtaccggccatccgaacggcgggcgctgattcatgctgacgcatcgactgatccgcgcgtatgcgctctacacgctggggtttctcggattcgtgctgctgatgtggcggatcgagcgcgccaccggctccggcgtctggatcggctacgtgttcctgttcgtgccgatcgcggtgtacgcggtgatcgggctgctgtcgcgcacgtccgatctcgtcgaatactacgtggccgggcggcgcgtgccgtccgcgttcaacggatggcgacggcggccgactggctgtcggccgcgtcgttcatcggcctggccggctcgctctatacgaccggctacgatgcgctcgcttacgtgatgggctggacgggcgggttctgcctcgtcgcgttcctgcttgcgccgtatgtgcgcaagctcgcgcgctacacgattcccgattttctcggtacgcgcttttcgagcacggccgtgcgtgcgctcgcggccggcgcggcgatcctgtgttcgttcgtgtacctggtcgcgcagatccagggatcggcctgatcgcgacgcgcttcatcggcgtcgatttcgcgatcgggatcttctgcgggctcgcgggcattctcgtgtgctcgtttctcggcgggatgcgcgcggtcacctggacgcaggtcgcgcagtacatcatcctgatcagcgcgatcctgattccggtgtcgctgatcgcgatgaagaacgggctcggcccggtgccgcagttcagctacggcaagctgatggagcgcgtcgcggcgcgcgaggcgcaggtgcgcgatgcgtccgacgaacagcaggtgcgcgacgcatatcgacgacaagccgcggacatccagacgcggctcgaccggctgccttcgtcgtatgcggatgcacgccggcatctcgccgaccagctggccgatctgcggcgccacaacgggccgctgcgcgagatcagccagcgcgagcgcgagctggcggactttccgcgcgatccggcggcggcgcaggtcgcgtggacgcaggcgcgtgacgacctgctggcccgtgccgagccgcccgtgccgatgcacgagccgtttcctgccgcgagcgatgacgaacgcaagccgcgcgagcggaatttcctcgcgctgctgctgtgcctgtcgctcggcaccgcgagcctgccgcacatcctgacgcgttacaacacgaccacgtcggtcgcgtcggcgcggcgctcggtcgggtggaccctgttcttcatcgcgctgttctacctcagcgtgccggtgctcgcggtgctgatcaagtacgagatcctcgcgaacctcgtcgggcggccgttcgccgaattgccggcgtgggtcacgcaatggcatcacttcgagcccgacctgatcagcgtcgtcgaggtgattcgcgatggcatcgtgcactggtcggaaatccagatgcagccggacatggtcgtactggccgcgccggagattgccgggctgccgtacgtcgtgtcgggactgatcgcggccggtgcgcttgccgcggcgctgtcgaccgcggacgggctgctgctgacgatcgcgaacgcgctgtcgcacgacgtctactactgcatggtcgcgcccgatgcatcgagccagcggcgcgtgacgatctcgaaggtgctgctgctcggcgtcgccctgttcgcgtcgtatgtcgcgtcgctcaatacgggaagatcctgtttctcgtcggcgccgcgttctcgctggcggcctcgagcttctttccggtgctggtgctcggcgtgttctggaagcgcacgacgacgcgcggtgcgatcgccgggatggtgaccgggctcgcggtgtgcgtgtactacatcgtgtcgacttatccgtacttcacgcagctgacgggattcgcggggcgcacgtggttcgggatcgagtcgatcagttcgggcgtgttcggggtgccggcggggttcgcggtggcgatcgtcgtgagtctgttcgatcgaaagccggatgactatacgcgggcgctggtggattacatccggcatccgtgacgcgggtgtcgttcggcatgctcgcgtgcctgggcagccagcgccggcgccgtgacgggcgggtcagagcgcggaaatgccgagctcggcgcccttggtcgtctgtacccggctgaaatcgcagctgccgtccgtcatgcccttggcgttcggtatcgcgacgcacacatacgcacggatgccatgcggcagcgccacgtggcgaaactcgccgaccttgatcgtcgcgacccggtcaacggcaaagcgatcgttgatcggtgtcgcgcccgacgggatcgacatcgtcacttccgacgcggcgttcccggtttgcgatttcagcgtctggctgctgccgatctctccgctgaccgagaagcgtatcgccgcctgtccttcggacacgcgttgaaccgtgaccgcgagcgtcggcatggcgattcccgccgcgcatttgccggcagcgcactcgcgaacggaaagcagcgtgcgaaacggggatgcaggctgaccgatgaccgacaggtcggtagacgatccgccgtcgcgcagcgccttgtcggccggcgggggagaggtcaccgcgacggtggtggtgatcgacggcggcgaaaatgccgttgcgcaagctgacagcatcgtcgaagcgacaatcgtcatggcgaaccctggactgaatcgcatggatctgactcgcggagctgaaacctcggatatcgtcagaagaatacacatctttagcgagcggggttcgggggcgatgtgcggtgggtgctcggttcagacgacgcagcggaccggacgagcgggcgtgccggcaacggtacgcgtgagcgcggccacgatctgctccgtcgagtatggcttgcgtttcatcgccaacctcccgttcctaacgggaaaattgccgccgacacactaacactcgtttgtgtccaggattcctagagcagatcacggttcacgccagcggcaacgagttaatcgagaaatttccgcacgatcttccagactcagcatcagcttgagtcaagtcggtaaatatttctcggaatttttggcgcgatcttttattataataattcctgaatcatgtaataaatcatttttaatgacgccatgaaaaatcataccgcttgtatttttcattttacccataacctcttttgctgatgcatgtgccaatagcgggaacgtatacgacgacttgtcttgcaccaaccaagccctggataaatcaaaaagaactcaatttaatttatcaaaaactttactctgccacacagtacaagaatgaatttgagcaatctcagaaggcttggctcaattaccgggacaagcagtgcctcggctatattgcagccgaggcgtcgcaatcccaaggcgccggctccggtctaatcacaaaagattgccttgtcacgataacaaaacagcgggttgattatttaaggactcttctcgggaaatagtagcctgacgtgatgaatttaattcgtatcggagacgacacccggccacggatcaaagtcgaaactgcttctacgtcaattcgattcgacggccggtatgtcgcacgcaaaggcgatcgtgtgtcgtgtcttcagcacgccgaggcgtcacccaaccttatcgaagaaggtgattcgtctatgacggacggtgctgtttaagagatgcctattggcttggtggagaaactcgattgctgagcgcagcgggaccgccttctccccaatgggaaggtgaacgccgagcacgattacatcgccgtgcccgagctctttcaagattcgcgccagtcgctaaggttcaccgtacaaggaattaagtccgtgatgactagctgaccgtattgagcagagaatcttgctgctacgggattcaacctcagctcgacgtttccgcctgtccgcacttcttcgatcgcgaacaattgagcatcactcagggcaatggaaaaggtgtggcagacaacaccgcccctctgtgctgggagccagctgaatcggaagatcgggatgcacgtccccgcatcggcttgactagtgccacatatcgccgagtctcgcgcgcaacgggcgactgaagagtccttgcaacgctcttagcaagtcgaggaattgacgcttgatggtcggcttgtgagccgaaaaacaaaaaccccgtaagtcattgactttacggggtttttgacatcatcctggcggagagaggggattcgaaccccgataggcgattaacctatacacgctttccaggcgtgcgacttaaaccactcatccatctctccggaagaccgagagtatagcaaactctggcggcagcccgccactcccttccgcagtcgtcaaaaatccgtcgtcatcgacagccacaccgaccgcggctcgccctgtgtcaggtacccgccggtcgtcgacgaccagtacgacttgttcgtgacatcgcgcacggtcgcacggaacgtcgtcttcccgccgaacagcgccgtcgcataacgcgcaccgagatcgtagcggtcccacgctgggatcgacgccacgcaaccgccgagcggaccccggggcgaacatgcgatcatcggtcgttcgaatgcgtcgtcatgattcgcgcgcgccggcagcggcccgcgcggccgaagacggcgacgccatcccgttcgcaagctcccttcagaaggaacgccacgccatgtcgttgtccgccttgctcgcttttgccctgatcctttccgtcggcgtcgcgacgcccggcccgacggtgttgctcgcgatgagcaacggctcacggtacggattgcgtcacgcgttggtcggcatgctcggcgccgttaccgccgatgtcgtgttggttgcgctggtcgggttcggtctcgggatgctgctcgaagcatcggaaacggcgttcgtcacgctgaagctggccggtgccgcgtggctcgcttatgtcggtgtgcggatgctgctctcgtccggtggtcgtgctgccgcgcaggcagtcgatcaggcgatgcccgatcgacggaccgcattcctgaagagtttttcgtcgcaatgagcaacccgaagtattacctgttcatgtccgcgctgctgccgcagttcgtcgaccggtcgcacgcgatcgcgccgcagtacgcgatcctcgcggcgacgatcgtcgcgatcgatgtcgtcgggatgaccggctacgcgctgctcggcgtgcactcggtgcgcgtgtggaaagcggccggcgagaagtggctgaaccgcgtcagcgggtcgctgctgctgattctcgcgggatatgtcgcgttgtaccgcaaggccgcgaactgacgcgacgatgcttccggcacacgatctcggccaaccggcccggcgatgaagccgatcgagcgtttcgcgctcgaaacgcacgacggtccgtacgcaacgtggccctcgcgtaccgccgtgctcgtgaacggcgagcgctccggcctcacggtttccggttacgtactgcttcgccagttcgagacgccggccgcttatctgctcgtcaccgactacgactgcctgttcgaggaggccgtcacgttcacgctcgtgtcgaaggatccattgaaggaaatcgcgcggcgcacggtcggcgcgatgtatgcgtcgtgccatctggacgacctcgcgtgggccgacgaccggcatttcagcgcgacgttcgtggacatcgacggacgatgggattttacgattcgtgaccgatcggtgccgttcatcctgcccaggctcgggatgaatcgcgtgcgggatcggtaatgcgcgatcggtgcccaagaggggtttggccgcgtgtgtgcgccgtttgaaacccgctcaaacaggcggtttcatttctctttcgcattgatccgacatgtaagtttcggcgcgtccgaatctcgcgtggccagcccgcatcgcggcaggagcggcggcgctcctgcatgacgtccgttcgtcaccttacaaaatgaatggaaattgaaagaattccttcccttgacgcaaggcgctcgggccatttattgtccgtctgccgcccgtgagagagcacggcggcaatcgcggatgcgcgccacgcgcgcacgacaacacgcagcagaaagcagaaaaggaaacgtggtagccacatgaagccgctattcgatgacaagaactccgatgcggtcagcgatcgtccttccaccccgtcttcgtcacccgtcgccgtgcctgccgccgccgtcactgtgccggccgcgcgcccggcggagaatgtccgcctgatcaccgtcgacgagatcgaccagctcggcgcgacgcagggcacgcggatcgccgctttttcccagcagattctcgcgagcgtccgcgcgtcggatgccgaccagttcggtgacaagctcaacgaactgatcgcgaccgcgaaggggctcgatccgcgcggcgccgacaagggcgggctgctcacgcaggtcacgcggctgtttcgctcgaccaaggagaagctgctgtcgcaatacgaatcggtgagcaagcggatggacacgctcgtcgtcgagctcgagagccatgcgcggcgccagaaggccggcatcgacgagctcgagcggatgtacaacgacaactacgcgctgcaccaggagctcgcgcagtcgaaggcgcacggcgaaacggcgctcgcgacgctgcgtgcgcatctcgcggccggccagcagccggcggacgacgcgttcgccgcacagcgactgctcgacgtgaagcgcaaggtcgacgcgctcgaaagcaagctcgacgacctcgaccgcgcgatgctgatgtcgaagcagctcgcgccgcagatccgcatggagcaggaccagaaacgcacgctgacgtcgaagttcatgacgatcaagaccgtgctgatccccgcgtggaccaatgcgttcgcgctctacctcgagcaactcagcacgaagcgcgcggcggcactcgcgaacgcgacgtacgacgcggccgacgaggcgatccgcgcgcaggccgacctgaaccgccagaacgcgcaggaagtcgcgaagctcggccagcgcccggtgatctcgaccgacacgttcgaatacgcgcagcagcagctgttcggcgcattcgacgacatcacgcagatcatcgccgacggcaagcgccagcgcgagcaggacgcgccgcgcctgcgccagctcgaacaggacctgatcacccgattcgctccgaagcacaactgagagaactgagagaacaccgcatgattacgcttgagaaacgcgcggcgaaggtcgcgatcgtcctcgaaaaacgccagatcctgaagccgcccgtcgtgcgcgtcggcgcggcgctcgacatctccggctccgcgaagccgctctaccagtcgggcgtgatccaggagacgcacgaccggatcctcggcatcgcactgaagttcgacgacaacggcgaagtcgacacgtggaccttcaccgaaggctacaaccggctgccgaccgcgacgccggacaactacggctcgtacatttccgaccacgtgctcgaagcgcggatcgacaaatggggcggcacgcagtacgcgccggtgatgaacgacatcgtcgacttcttcttccgcgcgccgcagccgtcgccgcaacgcgaagagaagcgcggcttcctgagccggctgttcggcggcgcggacgagacgcccgcaccggcggcttccgcgccggtgaacggccatctgcccgcatgggtgctgttcgtcaccgacgggcagaacccgaagaacgatcgcaagcgcgtgcgccaactgctggccgagtcgcagcactacccgctgtactggtcgctcgtcggcgtcggcgacccgagcgaattcggcttcctcgcggaaatcgcggaagagatgccgaacgtcggcttcctgcatctcgaatcgctcgacatcagcgacgaacagatctacgagcagttgatcacgcaggaattctgcgactgggtgcgcgcgaagtaagcgcggcccgcacgtcatttttcccgaaactcgaaactccacatcatgttgaaagacttcaagatcccgctgtcgctcacggcgctcgcactggtcgccgcgtatttcctcggcggcgtgaaagacatgctgatcgtcgcggtcctgtgcgtgctcgaaatctcgttgtcgctcgacaacgcggtcgtcaacgcctccgtgctcaagaactggtcggagaagtggcgcaaccgcttcatggtgttcggcctgccggtcgccgtgttcggcatgcggctcgtgttcccgctgctgatcgtcgcggtgatcggccacatcggcatgtgggatgcgctgacgctcgcgatcgagtcgccggagaagtacgcggcgatcctgacttccgcgcatcaccaggtgtcggcgttcggcggcgcgttcctgctgatggtgttcttcaagttcatgctcgacaccgagaaggacgagcactggatcggcttcctcgaaggcccgatgcgccatctcggccgcatcaccgcgctggaagtggcgctgacgctcgcgatcgtgatcgtcgcgtcgttctacgtgccgtcggcggaacaggtcgccttcctgctggcgggcgcgttcggcgtgatcagcttcgtgatcgcgcacggtatcggcgacctgatcggcggcgaggaaacgggcacgcgcgtggtgcgcgaaggcgtcgcgggtttcatgtatctcgaggtgctcgattcgtcgttcagcttcgacggcgtgatcggcgcattcgcgctgtcgaacaacatcttcctgatcgcgctcggcctcggcgtcggcgcggcctatatccgggagatgacgctcgtgctgctgaagaagggcacgctcgcgcaatatcgctatctcgagcacggcgcattctgggcgatcggtgcgctcgcaacgatcatgttcctcggcgtgaagttcgaggtgcccgaggtcatcacgggcctggtcggcgcggcgatgatcgccgcggccgtgtggtcgtcgatcgtcgtgcagcgcaaggaagaccgcaccgcggtggccggcgaataagcacgcgcgcgcgcgcacgcaaaccatcaacgaggggccgcgcagggcggccggcattgccgccggcgcaacggcggttccagcagaagaggttcagatgatcaatttgtcgaaaggcggtcgcgtcaacctgtcgaaggaagcgcccggcacgcagaaattccgcatcggtctcggttgggacgcgaacgcgacggacacgggcacggatttcgatctcgacgtgtcggtgttcctgtgcaagtacgacgcgcagagcaatccgaagctgatctcggatcagcatttcgtgttctacaacagcgaagtgcgcacgatggagcgcaaggaaaccttcatccagccgggcgacgatttcccgaagcgcgggatgcccgcgtcgaagtgcctgggtgtcgtgcacagcggcgacaaccgcacgggcagcggcggcggcgacgacgaagtgatcttcatcgacgtgacgaagctcgccgcggacatcgaggaaatctcggtggtcgtgacgatcgaccaggccgaagcgcgccgccagaatttcggccaggtgcgcaacagctacatccagatcgccgacgaggtgtcgggcgcggtgatcgcgaaatacgcgctcgaggaagacttctcgatggagacgtcggtgcaggtgggcagcttctatcgccgcgacggccacttcatgttcaaggcggtcggcgccggctacaaccgcggcctgggcgacttcgtgcgcgcgtacggcggcgcggtctgactggcggcagtccggccggcgggacaccgccgcgccgggcaggaagcagcgatgacgaatccgtccgacgagccgaagcggctcgagttcgatacgacgcccgagcgcacgcccgggcgtcttgcgttcgacgcgccgcccgcggccgcgacgacgccgggcgcgcgcgcgcccgagcggccggcaccgcaggcgctcgatttcgggccggtgcccgacaggcccgtgcgcaccgcgccggccgaggcggtcggccgcgcggtgttcggcgaatcgaaccatccgcagctcgaagcgtgcttccgcgccgcgcaggccagcttcccgaatctctatcccgactacgcgccgcgcatcgagcggcacatccggcaactggtgccgctgaagctcacgacggtcgcgacgatcggcgacggcgcgctggagacggcgggcaacctcgtcgaagccgtcgcggccaccacgcgcgaattcaacgaactcggcgcggccgacatgatggccggcatgctcgcgcaggcgacgcgcaaggccggcatgttcgaacgctggttcggcggggcggcgggccatgtcgactaccgggcggcgctcggtgcgctcaagcagtcgctcggcttctttccgcgccgcaccgaggagctcgccgcgaaggttcgccatgcggaagaaaatctcgtcgtcgtgctcgcggcgctgagcgcggtgtcggacgtcgtgcgcgcaccggacgatgcgggcgtcgagcgcacgctgttcgaccgccgcaatatcgtcgggcaggcggtgcagcagatccgcatgcaacccgcgcaattgcgcgggctcgatgagcgcgtgaccgatctgctgtcgcgcgccgatcacctgatgaacgttgtgctgccggcggcgctggcggcgcggccgcagcgctgagcgaacggcgcgaagggcacggatgcgcgcgccgcggcgcgcgcgctgcgcgggccacgccgcgtcacgccatttcacgtgcaccggcgcgagtctgctatcttcccgggcatctcattgctttcccgccgattctccatgaccgaccgcatcgttgccgcattcgatttcgacggcaccatcacgacgaccgacagctttcgccatttcgtccgctatgcggtcggcacgccgcgcttcgcatgggccgggctgcgtgcgctgccgtggatcgtcgcgatgaaggccgggctgctgtcgcgtggcgatgcgaaagcgaagttcgcgtcgttcgcgttcgggcccgtgcgcgaggacgcgctcgatgcgcaggcgcgtacgttcgtcgacacctacctgccgggcctcgtgcgtccggaaatgctcgaacgcattcgcgagcaccgggcacgcgggcacgaagtcgtgctggtgagcgcgtcgccgtcgctgtacctggagaagtgggcgaagacggccggcttcgatgcggtgctcgcgacgcggctcgcgttcgagcgcggcacgtttgccggccggctcgacggcgaaaactgctgggggccgcagaaggtcgtgcggctgcgcgggtggtggggcagccggccgccgaaacagctgttcgcgtacggcgacagccgcggcgacaaggaaatggccgagctcgcgaactggtcgtggatccgcgggcaggggccgatgccgccgatcggcggctgagccggcgcggcgccggttttacatcacgcgtcggcttgcgcgtggcgagcgcggcgcgacggtcgatacgggccccagcgattcgcacgcgcgaaggtgccgacgtcgttgaagcgcacgccgacttcacgcagcgccgcatgcgcggtgcgcgcggtcagctggcgaatgtagaacgggtcgcgcaccacgaagtgatggatcgcatgcgtgctgccgaagttgaagcagaacagctggaacggcagcatccaccacgggttgagcacctgcgtctgctggatcacgttgcgtgaatcgatatcgccgaagtaatgcatgttcgagctgacgaagttgatgcagaagctgcgcacgaagttcggcccgagccacaccacggccaggaaatcgacgacgctcatcgcgcgcgcgacgatggccggcaccgtcaccgcgtagccgaacgcatgcagcgcgaacaggccggcgtgatagacgatgaacgcatgccacagcacgtaatacacgtgaccgaccggcatgtacgacgacacctgctcgacgcgcaactgcaagcgttcggacggatcctgcaccggctgcgcggccacgtactgcttcaccttgcggcgcatcgcggccggccgcagcacgacggcgagcatgccgtcggcgatcatcagcaggcgcttcacgccccagcgctcgccgttggtgatgccgaattcctcgagatccgattcgccgcccgacaccttgtggtgatgcaggtgcatgcgtcgccgcgtccacgggttgatcgtgccgggccgcgtgagccagcacagcgccatcatcaggtgataggcccacggcgtcttcttgaagtacatcaggtggatcaggtcgtgctcgagctcgtggatcagcgacgtgacgaacgcggcgagcggcagcgcgacgtaccacgcgatcgccccgcgcgcatacagccaggcgatcgcgagcatcgcgctcaccgacacggccatcacggtcgcgccgacgaggttctggttgtcgagcagcggaaagcgcgcgcggatcgcgtcgctcgcggcgttgacctcgcggcggacgtacgcgaccttgtccgcgtcgtggcgaaaggcggttcgtgcgggttggctcatcgaccggattcctgcggaaagagtggggcgttatgccgatgtgacaagcataggcgcgcaccgggccgcccgcgagggccgcgggtgccaatggcggtgtcatttcgggccacgttggccggccggcgcggctagagtctcgccccggtgtcattgcgggccagcggcgctacaatccgccgaaaccgctccggagtcctccgcatggccctgtccgtcccggatgccgcgcgccagttgaacaaggcgacggtgtcgtccgcgtatgcgctgttcatgctgatgctggccgaggagcgtggtatcgacggcggccgcattctcgcgggctcgggtgtcgagcgcgaccggctcgcgcagcccgatgcgcgcatcacgccgctgcaacaggcggcgatcgtgttcaacctgctcgacgcgacggacgatccgtcgatcgcgatcgagatcggcctgcgcagcagcctgacgaaagcgggactgatcggcttcgggctgatgagctgcgcgacgctcggcgaggcgatctcgctcggcatccgctacctgccgacgcgcgtgccgttcttctcggtgcggctcgcgcggctcgacgggaccgtcgacatcgacgtgctcgaagcgtttccgctcggccggctgcggcagttcgcggtcgagaacttcctggtcgagacggcgatcctgttcaattcgctgctgtatccggtgccgggacgcacgctgcagtcgcgcgccgaactccatttcgaatggcccgagccgccgtggttcgagcgttatcgcgcgcgcctgccgcgctgccatttcgacgcgagcgcaaaccgcatccgttgcgatgccgcgctgctcgacgaaccgatcggcaccgcgaacgcgcacaccgcgcagatgatcgtgcagcagtgcgaggccgaactcgcgcggctcgggtatgcggaaagcatcgtcgagcgcgtgcgcaacctgctgatctgcggcgagggcggctatccggcggtcgacgacgtcgcgcgcgagctgcatgtatcggcgcgtacgctcaagcgcaagctcgccgaatacggtgcgacctattcggcgctgctcgacgagatccggttgcgcgacgcgctgcggctgctcgaggacgcggctgccggtggatgagatcgccgcgcgcgtcggttatacggatcgcgcgaacttcacgcgcgcattcaagcgctggacgggtgttgcgccgagcgagcggcgctgaacgcgggcatgcgccggcccgcgtggcgggcctgccgagtcgtgctccacgtatcccttcttcagacgatcgcgacccagttcgcgccgcgcccgcccggcacgcgtgcgtgcggcgacagcgcgccatcgtcctgcgagatcgcatataccgacacgtattccgactgttcgccgcacgcgacgagccagcgccccgacgggcgatcgcgaacccgcgcggctgcgtctcggtggccgttgcgtgcgcgggttcgaacgtgccgtcagcggtgcggcgatagcagagcaggcggctcgacgtgcgttcgctgacgtaggcgaaacgctcgtcggggctcaggtgcaggtcggcggcccagacggagggctcggtgggcgcgggcggccgcgcatggcccggcgcgagttcggcgacggccggatggcgcgcactcacgtgcgcatcgccgagccggccggtatcggggtcgcgcgcgaacgtggcgagcgtggcctggaattcgctgacgacgacgagcgctcggccgtcgcgcgcgaactgcaggtggcgcgggccgaacccggccggcacgcgcgtttcgccgtgttcgagcgcgcgcaggccggccgcgtcctcgaccagcgcgaagctgaacacgcgatccgagccgagcgagctgacataggcgaaacggttgtccggcgacacgatcaccgagtgcgcgttcgcgatgccgcccacgacctgcagcggcgtgccgtcgccgtcgcgcacgcgcgcggcgtcgtagaggctcagcgaatttccgccgtacgacgcgccgagcagccagcggccgtcgcggtcgagcgacaggtacgcatggctcgcgtcgattgcggtcgcgccgatgcgcacgagcgcgccggtggccggcacaacgcggaacgcgacgatcgtcggctgttcgccgcgcgtcgcgacgtagagccgcgcgcggtcggcctgcacggcgatcggcatcgcgacgtcggctgcgggatagcgggcgagcggcgcgagcgtgccgtcggccgcgagggaaaatgtggcgaggtcggcgtcggcggcgttcgagacgacgacggtcaggcggtcagtgttcggcatggcggagcatcgatgcgttcgtcagggcggtgtcggccggcaggccgcgcggcggatcgctgcgccggtgcgtgcgcgcgaacagcgcggccacggcggcgacgagcgaagcgatcgcgagcgcatacagcccgcccgtgatcgaacccgtatgttgcttcagatagccgaaggccgtcggcgcgacgaagccgccgaggttgccgaccgagttgatcagcgcgatcacggccgcggccacgcgcgtgtcgagatagccctgcgggatcggccagaacagcgacgccgcggccttgaagccgagcgcggcgaagcagatcgacgcgaacgaccaggccggatcgtgcgacgtcgacgcgaacagcccgcacgcggcgagcacgagcgcgaacgcgagccagcgctgcggatgcttccatttcgacgacagcaccgcgaagccgtacatcgcgccgatcgcgatcatccacggaatcgtgttgtacaggccgacctggaaatcggtgaggccgcccatcttgcggatgatcgtcggcagccagaacgtggccgcgtagatcgtcagctggatcgagaaatacaggaagcagaacagcatgatctgcggatcgcgcagcagcgtggtggcgcgcaccggcacgttcgaacggacgtcgcgcgtcgcgcgttcctcgtcgagcgcgttctgcagcgccgtgcgttcctcggtggtgagccacgtcgcgtcgcggatgtgcgatttcagcagcagccagctcgcgccgcacagcgcgacggagaacagcccttcgatcaggaacatccactgccagccttcgaggccgaagccgcggatcgacagcagcgcaccggtgacgggcccggacagcaccgacgcgaacgcggagccgccgaggaagatcgccatcgccttgccgcgctcctgcggcggcagccattgcgacaggtacagcacgacgccgggaagaaaccggcctcggccgcgccgagcaggaagcgcagggcatagaacgacgtgtcgttccacacgaacgccatcgcggccgcgacgatgccccacgtcgccatgatccgcgcgagccacacgcgggcgccgtagcgttgcatcagcaggttcgacggcacctcgaacagcgcgtagccgacgaagaacaacccggcaccgaggccgtacgcggccgcgccgatgccgatcgacgcttcgagatggcgatcgacgaagccgacgttcacgcggtcgatgtagttcgcgatgaacatgatcagcacgagcggcagcacatgccacttcactttcgagacggcggacgcgagcgggtcgcgtccgggcagggcgggcgagggcgggttcaagcgtgtctccggtcgggcggggctatgtagtatgtcgtcgtatgacatggtacgcctgagtgccgatggagacgtcgcgggtttacccgggaattacccggatattgaggaatttcatgagattcatcgggcgtccgtcaatgtctgatgacatatgacatgaaacgagtgtgtacccatcgccgggatacccggtggcgatccgcgcgcgtggtgcatccccgggcaacccgtccggcggctgccctcgcggccgctacgccatcgacacgacgctgttgagcagcgtcttcacgagcacggcctgccgcgtcgcgcccgttttcgcgaagatgccgcgcaggtgcgcgcgcgcggtgttcttcgtgatgccggtcgcggcggcggcctcgtcgagcgtcagcccgtcgacgagcagcagtgcgatttcggtttccatcggcgtgagccggaacagccggtgcagcatgtcgcgcgacgtctgcggcgacgacacgggatcgcgcacgaacaccgcgacggccggccggtgccggcggtcctcggcgccgcggtagggtgcgagcgggcgcagcagcacgctcaacggcatcgcgccgccggggcgcgacagcgtggtggcttcgatgcgggcgagcgcgcccgcgcggaaatgctcgagcgcggcctgcaatgccttctgcagccggcgctcgtcgagcgggcacgaggcgtggagctgctcgtggcgcacgcacagcccgtcctgctgctcgatcagccgctcggcgatgcgattgcgcttgatcacgcggccgtcctcgtcgacgatcgcggtgccgacatcgagccggtcgacggtgcccgcgtacagcgcgcgttcggcatcgagcacgtcgaacgccgcgtgcagttcgactgcccgctgcaggtgcggcagcagcgtcgcgacctgcgcgcgttcggccgcgtcgaagtcccgcccgccgtgcgcgcggctcacgaagaacgcgcattcgacgccgcgttcgccgcgcaggttcgcgccgaggatgtagcgcaggtcgagcggctgcaggtactgccggtagaaatcgtgcgcgcgccacgcggtttcgccgaacagccggtcggccgtgaagacctggccgggcggctgatcgagaaacgggcacagcgcatagaactgctcgctgtacgacggctcgccgggcagcagcgggccgtgcgccgacgcgttgatgatgagcccgtgccgtgcgccgcccgggttgcgcagcaccagtgtcgtgaagcgcgcgtcgagccgcacgcggaccgcttcgaggaagccggcccacggggtcgcttccgacgggccctgatagacgagcccgagccacgcgctgagttcgcgcgccgtccacgcggcgtcgtcgaagccgtcgtgcgcggccggatcgccgggtgccagcgcaatgggcatgctcgtgttctcctggatcggggtgaagggttcccgagccagcataccggccgcccggcggcccgcgtcatccgaacggaggaggcggcgcgcccaggccggcaggcgggcaaccgccgggctgcccgcctgcggcgcctacgccgcgcgctcgcgcagcaggtaagcgacgatgcgcccggccgcttcgtcaggggactcggcgaccgtatcgacgcgcagttcgggtcgcgcgggcggctcgtacggcgaatcgatgcccgtgaaatgcttcagctcgccgcgccgcgccttcttgtacaggccctttgggtcgcgctcctcggcgaccgcgagcggcgtgtcgacgaacacctcgacgaactcgtcggggccggcgagcgcacgcgccatctcgcgttccgagcggaacggcgagatgaacgacacgagcgtgatgagccccgcgtcgagcatcagccgtgcgacttcggcgacgcgccggatgttctccacgcgatcggcctcggtgaagccgagatcgcgattgagcccgtgccgcacgttgtcgccgtcgagcaggtacgtgtgcttgccgagcgcgtgcagccgcttctcgacgaggttcgcgatcgtcgacttgccggcgcccgacagccccgtcagccacacgatgcgcggcgtctgcgccttctgcgcggcacgcgcggcgcggtcgacgtcgacggcctgccagtgcacgttgtgcgcgcggcgcagcgcgaagtgcagcatcccggcaccgaccgtgtcgttggtgaagcggtcgatcacgatgaagccgcccgtgtggcggttgcggtcgtacggatcgaacgccacgggccggtcgaagctcaggttgcacacgccgatttcgttgagcgcgagcgtgcgcgccgcgagatgctcgcgcgtgttcacgtcgaccttgtacttcggcgtcgcgcaggtcgcaccgaccgtctgcgtgccgagtttcacgagatacgggcggccgggcagcagcggcgcgtcgtgcatccacacgagcgtcgcctcgaactggtcggccacctcgggcggcgcatccgcgcgcgcgatcatgtcgccgcggctgatgtcgatttcgtcggcgagcgtgagcgtcaccgcgtcgccggcgtgcgcgatgtcgctttcgccgcgttgcgtgatcaccgacgcgacgcggctctcctgccggacggcagcacgcgcacgcgctcgccgacgcggatctcgcccgatgcgatgctgcccgcgtagccgcggaaattcaggtgcgggcggttgacccactgcaccggcagccggaacggctcgtcgcgcgtcacgcgcgcggcgagcggcagcgtgtcgagatgctgcatcagcgtcgggcccgcgtaccacggcatccgcgtgcccggcgcgatcacgttgtcgccgcgcagcgccgacatcgggatgctgacgatctccgccagcccgagctcggccgcgaacgcgcgatagtcggcgtcgatgcgctcgaacacggcccggtcgtagtcgaccaggtccatcttgttgatcgcgagcaccacgcgcctgatgccgatcagcgcgacgagatggctatgacggcgcgtctgcgtgagcacgcccttgcgcgcgtcgatcaggatcacggcgagatcggcggtcgacgcgccggtgatcatgttgcgcgtgtactgctcgtggccgggcgtgtcggcgacgatgaacttgcggcgcgcggtcgcgaagaagcggtacgcgacgtcgatcgtgatcccttgctcgcgctcggccgacaggccgtcgacgagcagcgcgaaatcgagctcgccgccctgcgtgccgaccttcttcgaatcggtttcgagctgcgtgagctggtcgtcgaacagcatgttcgattcatagagcaggcggccgatcagcgtgctcttgccgtcgtcgacgctgccgcacgtgatgaagcgcagcaggtccttcgtttgcgcatcgtcggcgtgcatgttgggcgtcgcgtgcgtgggcgcctcgggtgcggtgagaacgtgtgccatcagaaatatccctcctgtttcttcttttccatcgagccggccgagtcgctgtcgatcaggcgtccttgtcgttccgacgtgcgcgtctcgcgcatttcccgaaggatgtcgtcgagcgagctcgcatcgctgtcgatcgcgcccgtcagcgggtagcagccgagcgtgcgaaagcgcaccttgcgcatctgcggcgcttcgccgtggcgcagcggcaggcgttcgtcgtcgaccatgatcagcgcgccgtcgcgttcgacgacgggccgttccttcgcgaagtagagcggcacgatcgggatgtcgtgaagctggatgtactgccagatgtcgagctcggtccagttcgagatcgggaacacgcgcaggctttcgcccttgcgcttgcgcgcgttgtacagcgaccagagttcggggcgctggcgcttcgggtcccagcggtgctgctcggagcgcagcgacacgatgcgttccttcgcgcgcgatttctcctcgtcgcggcgcgcgccgccgaacgcggcatcgaagccgtaatgatcgagcgcctgcttgagcccctgggtcttccacacgtcggtgtgcatggccgagccgtgcgtgaacggattgatgtcgttcgcgatgccgtcggggttcacgtgcacgcgcaggtcgaggccgaggcgcgcggccgtctcgtcgcgaaacgcgatcatctcgcggaatttccacgtcgtatcgacgtgcagcagcggaaagggcggcttcgccgggtagaacgccttcatcgcgagatgcagcatgaccgagctgtccttgccgatcgaatacagcatcaccgggttctcgctctcggcgaccacctcgcgcatgatgtggatgctttcggcctccagtcgctccaagtgggtcaacatcgttcgtctccttgtttcatgccggcgccgcgcgacatgtgcggcgtttcgtgcatgacgccaacggtatcgagcgagcggcatgccgctcttcgtccgggtggactaaaccgcggcgcggcggtggagcggatctttccttagtccacccggacgaagaggtgtgcgacggcggcgcttaaggtgagcgctcgaccatcggcggagacgacacatgacggacgacacacgtgccacgcaattgctttcgggccagacctgggccgatttctgcgacaccctgaaacgcagcggcgagcagatcctgcgcgccgaggcgccggacgatccgctgacacgcgcggaaggctttcgttacctgagccggttgatgcgcatcgcgctcgaaatgcacgtcgaattcgcggacggcgcgtggcccggctttttctcgccgtcgcacgagaccgcgaagatcggcgccgacaatcccgacaacctgtacctgtacgcgcggctcgacggccgttgcgaataccgcgtgacggggcggcgcggcacggtggcctacctgagcttcggcacgcagaagggcggctacgagaccgacggcaagatgctgcagacgggctttctcgatgcgaagcagctcgagatcgcaccggacggcagcttcgagatcgtgctcggcgagacaccgcgcgcgggcaactgggtacgcatggagcccggcaccaacgcgttgctggtgcgccagacattcctcgaccggcgcacggagacgcccgcgcaactgaagatcgaacgcatcggcgcgcacgaccgcccggcgccgctcgatccgctcgtgctgcagggcggcctcacgcgcgccgcgcagttcgtcgagcagacggcgaagctgttcgccgactgggccgcgggctaccagtcgcacgtgaacgcgctgccgcccgccgaccaggcgctgtgccagtcggtcggcggcgacccgaacatctactactaccactcgtgctgggaactggccgacgacgaggcgctcgtgatcgacgtcgacacggtgcccaactgcgatttctggaacgtgcagctcaacaactactggatggagtcgctcgactaccggcacttcgatatctgcgtgaacaagcacggcgcgcgacggaatgcggacggtggcgtgacggtggtcgtcgcggccgcgcggccgggcgacgcgaactggctcgatacggccgggcatcgcaccggcacgatctgctggcgctgggtcggcgccgcgcagccggtgcatccgcgcacgcgggtcgtgaagctcgccgcgctgaaggaggccgcatgaacgcgccgatcgacctgatccgcgcgcggctcgacgccgacggactgatcgccgaggccgtgtcgcgcacgggcgggctcaccgcgttcggcgacggaccgtatcgcgaggcgctcgacgtgatgtgcgcgtcgctgatcgacgaagcgaagctgtccgaacgcggcgcggcgatgatgcgcgagaagctcgtcgggcaactcgtgaaccggctggtcgtcgaggattacttccggcgccatccggagatcgcggacatcgcgatcgacgatccgctcgtgatcgtcggcctgccgcgcacgggcacgacgctgctgcagcggctgctggccgtcgatccgcgcttccatactgccgcgtggtgggaaacccgctacccggcgccgctcgcgggcgagacgctggccgagccggcggtgcgcatcgcccgcgcgcaggccgaagtcgcgacgatgatcgactgcattccgcagatcctggcgattcatccgctcgatgcgatgctcgccgacgaggagttcatgctgatggagcactcgttcgtgtgcgcgatggattcgtacgcgaacgtgccgcgctatacggcgtggctcgcgcggcaggatctcacgccggtctatacgtacctgaagcggatgctgcagttcctgcaatggcagaaggcacagcgcggggtcgcgccggccgcgcgctggctgctgaagacgccgcagcacctgcatgcgctcgacgtgctgtgccgcgtgttcccgcgcgcgcaggtcgtgctcacgcatcgcgacccggcgcagacgattccgtcgatggccagcatggcgcacacactgtggcagatgtatgcggacgatcccgatccgcttgcggtcggcgcgcagtggaacgcggggatggcacgcgcgatcggcgccgcgatggccgcgcgcgatgcgctgccggccggccgcttcctcgacgtgcgtttcgaggacacggtgtcgaatccgctcggcgtggccgaggccgacgcgtttgccggcctgccgctcgatgcgcggcggcgcacggcgatgaccgactggatggcgcgcaacggccgcgacaagcgtgccgcgcacgactattcgatcgcgcgcttcggcttcaccgatgcgcagctcgcgcgcgacttcgccgcgtatcgcgcgcggcacctgcgggcggccggctgacggcccggctcgcgaaaccaacgacaaccaggagacaagccatgttgctaaaggacaagatcgtcgtgatttccgggatcgggccggggctcggcgtgaaactcgctgtcgaggccgcgcgcgagggcgcgtgcggcgtggtcgtcgcggcgcgcacgacggaaaagctcgacgacgccgaaacgcggatccgcgcactcggcgtcgattgcgacgtgctgaaggtgaagaccgacatcaccgatcgcgcacaatgccggcagctcgcgacgcaggccgtcgagcgcttcggccggatcgatgcgctcgtgaacagcgcattcgtgcacggcaggtttcccgaaccggtggaggacgccgacctcgacggctggcgcgcggtgttcgacaccaacgtgttcggcacgatggcgcttacgcaggaagtcgtgccgcacatgaagcggcgcaagcgcggcgcgatcgtgatgatcaacacgcaggcgacccgcaagccgtttgcaggggaaggcggctacgctgtatcgaagggggcgctcgccgttgcggcaaaatacctggcgcgcgaactcggcgtgcacggcattcgcgcgaacagcatccacatggggtggatgtggggcgtgccgacccggacgtatttccggcaggcggcggccgaatacgggatgacggaagagcaggtgatcgcgccggtcgcgtcgaacatcgcgctcgcgaagctgccgaccgacgacgattgcgcgcgcgcggcgctgttcctcgcgtcggactacgcgaacgcggtgacgggcgcgacgctcgacgcaaatggcggcgatttcatgccctgacgacggagcaaaggatcatgcaggacaaccacgacgaacgacacttccttgcgttcaacggcgacgcggacggcctgtgcgcgcttcagcaactgcggctcgcggagggcgtgcgcggcacgctcgtgaccggcgtgaagcgcgacatcaggctgctcgagcggatcgacgcgcgcgcgggcgacatcgtcaccgtgctcgacgtgtcgcacgaccagaatcgcgatgcctgcgcgcggctgctgcgcgacggcgcgacggtccgctatttcgaccatcacttcgcgggcgagctgcccgacgatccgcgcttcgacgcgcatatcgacacggcggccgacgtctgcacgagcgcgatcgtgaaccgttatctcggcggccggcacgtgcgctgggcgatcgtcgcggcattcggcgacgagctgccggcgctcggcggcgcgctcgcgcgcgagcacgggatcgacgacgcggcgcgcgacacgctcgccgaactgggcctctacctgaactacaacgcgtacggcgagtgtgtcggcgatctgcatttcgacccggcggtacttgccgatgcgatgctgccgtgcgtcgacccgctcgagttcgtgcgcgagaccgccgtgttcgccgcgctgcgcgacggctaccgcgacgacatggcacgggcgtgcgcactcgcgccgctgcgcgaggtgcccggcgcgacgctggtccggatgcccgatcatccatgggcgcggcgcgcgacgggcatgctcgcgaacgagcggatgcgcaacgcgccgcatgcggcgctcgcggtgctgtcgccgcgcgcggacggcgggctcgtcgtcagcgtgcgcgtgcccgacggccggccgctcggcgccgacgagttctgtcgcggctttccgaccggcggcgggcgcaagcgcgcgggcggcatcaatcatctgccggaaaccgagttcgacgcgttcgccgagcggttcgaggcggcgttccggctcgattgacgcaacggcccgcgaggcgcacggcgtgcgcctcgcgggcggcggagtgtggccgccgggttgcggcgcgatcaaccggtcgcgcccgcgagcacggccggcacgttgtggccgtagcagcgctcctcgacacgctcggcgatgcgccagccgagcgcggtacgcgcgaaccggtcgacgtaccacagcccgagaaacatcacctgcgtgccgccgtccggcagcgcgacttccatcggattgaagcagatcgtgcggccgcgcgcggtgtcgccgtcgagccggatcgacaggttgccgaccaggtgctggtactgcggaaaccgcggcagcacggtgcgcagccacgccttcacttccggataacggcccgcgatgccgcccatcgcgcgatagtcgatcgccgcgtcgggcgtgaacaccgcgtcgagcgcgtcgaagtcgcgtgtgtcgatcgcggtcgaatacgcgacgatcagttcgcggatgtcgtgatggtcggacagcgtttgcagatcgggcatcggcggctcccggtcaggcgccgttgcgccggcgtgccgcatggagcgcttcggcgcgccgcttcacgtcgcgcgcgcactggtcgaaaccctgttttacccacgtaccgtggttctgcatgatcgtgtccgcgttgatgccgaggaactggtcggtcgtgaaataacggcagcgttccgcgccgatcgcatcgatgtactggtcgcggcgcgcggcgtccttgttgtcgtcggtcgggcgctgctcccacgacagcaggcgttccggttcgcacgcgacgaggatctcgttgacgggaatcacggtttccgtgccgggaatgcgcacctgcatgtgcacgaaatcgccgagcctgccggtcgtttcgaagccgacgcagaacgtgttccattcgccgtagcgcgggaagtcggtcagcacttcccagacgacggaggccggtgcgtcgatgtcgacggtgatcgaggtgacgagattcgagggtttggtcatggcggcgtatcgggtgagtagcgggtgaagccgcgcgcccggccggccgggcgccgcagcagtcggaaaggttcgcgccggcatcggccggcgcgcgtggcagggcgggacgcgcggtgccggtagcggccggcacgtgccgcgcggcgtacccgacatcgagcgtaggccggcgcatgcggcgaagaatcgtcggaatggactaaggcgtttcaccggggcggcaggcgggcgcgacggccgcgaccgtcgtcgatccgccggcgcgccgaacgtcgacaccgtgcggcgcagccgcgacaatacgcgtctcttcctgctttcgtcatcgaggtgcccgtgcccgccaagtcgtccgttgctcccgcgatcgtctggttccgcgacgatctgcgcgtgaccgaccagcccgcgctgacgcgcgcggtggcgtcgggccggccgctcgtatgcgtattcgtcgacgatacgggcgccggcgccgggcgcgcgcccggcggcgcggcgcgctggtggctgcacgggtcgctggccggcctcgacgcggcgcttgcgcgtcatggcggacgcctgctgctgttgcgcggcgacgcgccgcgcgagatcgaacgcgtcgtgcacgacacgggtgcgcaagcggtgtactggaaccgtcgttatgcgcaaccgcagcgcgacgccgacgcggcgctgaaggcgtcgctcaaggcgcgcggcgtcacggtcgagagcagcaacggcagcctgttgaacgagccgtgggaggtgctgacgggcagcggcgggccgtaccaggtgttcaccgcgtactggcgcgcggcacgtcgcgatcgcgcggtggccgcgccgctgcccgagcccgcacggatcgggtttcatcgctggccgaaggccgtgagcgaccgcgcgctggcgctcgatgcgctggcattgcgtccgccggcgccggattgggccggcggcctgcgcgacgcgtggcccgcgcccgacgaaggcggcgcgcacgcgcagctcgacgcgtttctgacaacctcgctcgccgattacgcggatgtgcgcgaccgtcccgaccggcccgcgacgagccggctgtcaccgttcctgcgcttcggcaacgtgtcgccgcgacaggtgtggcacgcggtgcagggcgccgcgcaggccggcggcgcggcatgcgcggcgggcgccgacaagttcctgagcgaactcggctggcgcgaattcagctacacgctgctgtaccactttccggcactcgcgaccgacaacttccgcgcgcagttcgatgcgatgccgtggcgcgacgatcccgccgcgctgcgcgcgtggcagcgcgggctgaccggctatccgctcgtcgatgcgggcctgcgcgaactgtggacgaccggctggatgcacaaccgcgtgcggatggtcgtcgcgtcgttcctgatcaagcatctgctgatcgactggcgcgcgggcgaagcgtggttctgggacacgctggtcgacgccgatcccgcgaacaacgcggcgagctggcagtgggtggccggctgcggtgccgacgcggcgccgtatttccgcatcttcaatccggtcgcgcaggggcggaagttcgacccggacggtgcgtacgtgcggcgctgggtgcccgagctgaccggcctcgacgccgcatcgatccacgcgccgtgggaggcctcgccgctggagctcgaagcggcaggcgtgcggctcggcgtcgactatccggagccgctcgtcgagcatgcggccgcgcgtgcccgcgcgctcgatgcgctggccgcattgccgaagcgccgctgaccgcccgctccgggttgccgcgtcaattgcagaacgcggcgtgttcgagcagcgcgtacgcgacgcccgaatcgaagtaggccgcgccgcaccacgcgacgaacgtgagcgtgccggcggccagtgccgcgcggatcatgcccacgccgcgttgcccgctgccggacgcgcgacgcgcgcgtcgttgatcggcaggtgcagcagcgccgcgagtacgccgagcgcgatcgagccgatccacagcggcatgtacgaatgcgtcgcgtcgtacacgagcgcaccgagccagacaccgaagaagctgccgagctggtgcccgaagaacacgaagccgaacagcgtcgcgatgtagcgcacgccgaacacctgcgagatcacgccgttcgtcagcggcacggtgccgagccacgtgagccccatgacggccgcgaacacgtagacgctcgcgggcgacagcggcgcggcgacgaatacggccatcgtgagcgcacgcacgaggtacagcaccgacagcacgtacttgcgccgcagcagcccgccgagatggccgcacgcataggtgccggccacgttggtcagcgcgatcagcgcgagcgcgacgctcgcgtggcgcgccggcagcccgtgatccagcaggtacgcgggaagatgcgtcgcgatgaaggcgagctggaagccgcacgcgaagaagcccgcgttcagcagccagaagccgcgatgcgcgaacgcctcgcgcacggcttcgccgatcgactggtcggggccggcggcggcgccggcaacctgcgcgggccggtcgcgcagcagcacggcgagcggcgcgagcaccactgcgacgagcgccagtgcgatgaacgcatgccgccagccgatgccgccgatcagctcctgcgcgacgggcaccatgcagaactggccgagcccgccgatcgcgcctgcgacgccgagcgcccagccgcgccggtcgggcggaaacaggcggctcagggcgccgtagatcgatgcgaacgccgagcccgacagcgcgatgccgatcacgagcccggcaccgaccgtgaacatgccggtcgtcgccgcatgcgccatcgtgacgagcccggccgcatagagcagcatcccggcgacgatcacgcgcagcgacccgaaacgatcggcgatcatgcccgtaaacggctgcgcgacgccccagatcaggttctgcagcgccagcgcgagcccgaacgcttcccgcgaccagccgtgatcgagcgacaccggcgcgaggaacaggccctgcacgtggcggatgccgagcgcggcgcccatgatcaggccgccggccagtacgggcagccagcggcggcggacttcctgctcgatcggggtcatgcgtgtctccggaagggggcgcggcaaaacggccgcgctcgatccgattagacgatcgggcccgtcgacgctcaagcgatcattcggtcaggttggcatgcgtgtggggaatgcgacgaggggcgcggggatcgggcgtgcccggccgcggccggcggcattcgcggaaccggcttcggctccggcctatgccgacgccgtatcgtgcgcacgcatcgcggtatcgcattcggctgcttcggcgagcatccagtcgcggacttcggcgacttcgcggcgtggtgccggatcgtgctggaacagccagtagccgtacgcctccgacagcgcctgcgtgtgcggcccgagcaccgcgagccgcccgtccgcgagcatcggcgcgacgagcgcgagccgcccgagcgcgacgccctggcccgcgatcgcggcctggatcacctggtcgtactggttgaagcgcagcacgcctttcgggcgcgcgttgccgagcccggccgcgagcaggtgcgtgcgccattgcagttgcggctgcggcggcccgtcgaattcgagcaggacgtggtcggcgatcgcggccgcgttcgtgacgggccgcgcggcgagcgcgggatgggcgaccggcacgacgatctcgtcgaacaggtgcagcgcgccggccggcgcgcggtcgcgcgggcaatagcggacgccgaggtcgatgccttcggcgcgcaaatcgagtaccttgtcgttcgcggcgacgcgcaggtcgatctccggcaggcgtgcctgcagccgcccgagccgcggcagcaaccacagcgcggtgacgccgatgctcgcggtgatcgtgacgggctggcgctcgcgtgcggcggcgagcgacgcgacggtgtcctgcaggccgtgcagggccgcatcggcgacgcgaaacagccgctcgccttccggcgtgaacgcgatcttccggtagccgcgctgcagcagcgcgacgccgagatgcgcttcgagcgcgtgcacctggcggctgaccgccgattgcgtgacgcacagatcctgcgcggcgagcgtgatgctcatgcggcggccgacggcgacgaaaccgcggacgaggtcgagcgacgggagacggacgagtggcgttgacatgcgcgtgactcatgcgaacggagcagcaagattggttgagaacgcggggcgcgtcaagttcaatggaggctggcgcggggagcgcggggctgaccgcgaagcatggggttcgggtaagcgctaaagcgccaactcggaccgaccgcgaagcatggggtccgagtaagcgctaaagcgctaactcggaccgacaggagactcgatgacgatttcgaacgaaagcagcgggacaacgcagggcagccgtgcggcaggcgcattgccgcccgagcccgtgacgctgcgcgcggccgacggctacgaattgcgcggccatgtatggcgccatcgcggcggcagtgccgcgcggcccgtaacggtcatcaattgcgcgacatcggtgcgttgcgactactactttcgtttcgcggcctggttgttttcacaggggcgcgacgtgctcgtctacgactatcgcggcatcggcgggtcgcgcccggcgcagctcgcgaagctgcgcgcgaactggctcgactgggggcggctcgattgcgacgccgcgctgcggtacgcgcacgacgcgtttccgggccagccgatcgacgtggtcgcgcacagcatcggcgggttcgcgctcgggctcgcggcatcgaacgcacacgtgcggcacgcggtgacggtcggcgcgcagtacgcgtactggcgcgattacctgccggccgaacggcggcgcatgtggtggaagtggcatgttgcgatgccgctgctcgcggccgtgttcggctacgtgcccgcgaagcggctcggctggatggaggacacgccgcgcggcgtcgcgttgtcgtgggtgcgctcgcaggcgcgcttcgaggatggttatacgcgcggcctgctcgccgaacccgccgcaagccgcgccgcgttgcccatccgcttcgcgggactgtcggcgccgatgctcgcgatcggcctcgacgacgacgggttcggcacggtcgaggcgatcgagcggctggtcggctactacacgggcagcgacgtcacgcatctgcggatcgcgccggccgacatcggcgtcgatgcgatcggccatttcgcgtttttccacagccgcttcaccgacacgctgtggccgctcgcgttgtactggctgcagcacggcgtgctgccggccgatgcgccgggccgcgtgcatgcgcttcacccggcgtcgcgcgggcgagggcgggcagcggcgtgccgggtgtcgccgcgaacgggtgaggcgcggcggctgcacgatgcgtcgcgggcatggcgtgctgccgtgcgcggccttcgcatgcggcacatgaagccgccccgattcgatgcggccgcggcgagtcgcacacaagccggttcgtgcgccggcgcgatcgattaacatcgggcgtttccttccacggcacaggctgctgcgcaccgatgtccattccgtccgattccgcttctccggccgataccgcccgcgcatggcgcgtgtacgcgctcgatgtgccgcccgccgcggcacgcgcgggtgtgcgggtcgcgcgtatcgatttcgactggagcgtgccgctcgcgtcgccggcctatgcggcgctgagcgatgacgagcgcgcgcgcgccgcgcgcttcatgcgtcacgaggatgcggtacgcagcgccgcgacgcgtgccgcgctgcgcgacgtgctcggcgcggccctcggtgtcgcgccgcatgcggtcgcgatcgtcgtcgacgcatcggggcggccgtcgccggcccccgcgcatcggacctcactcgatttcaacgtgtcgcatgcgggcgatcacgcattgctcgcgtgggcgcccgcgggccgcgtcggtgtcgatatcgagtgctgcgaccgcgcggccgactggcgtgcgctgacacgcgaagtctgcgcgcccgccgaggctgcgtggctcgacagcgtgtcgcccgccgcgcgcgcggcggcgttcatgcgcgtgtgggcggcgaaggaagcgctgctcaaggcgctcggcaccggcatcgtcggcgggttgcgagcgttcgcggtcgtgccgccgcgcgatgtcgcgacccctgcgacgacgatcgtcgagccggccgcgcccgccgccggcgtcgcagcgttcgacgcggcgtggctcgacgcggcgcccggctacgcggcgtgcattgcgtggacgcgtgcgtgagccggcgcccacgcgcggcgctcattcgagcggcgcgtcgttcggtgccgcgtagcgcgccttgatcacgtcgctcatcgggaagtcgaacgcgagccccttcggcggcaccggcttcatgaaccacctgtcgtacagcgcatcgatctcgccgcgcttcatcgactgcacgagcacgccgtcgacgagcgccttgaactgcggatcgtccttgcgcagcatgaacccgtaggcctccgacgactgcggcgtgccgacgatctgccagtcggccggcttcgcggcgagctggcgcacgcccgcgagcagcacgtcgtccatcatgtacgcggccgcacggcccgattcgagcgtgaggcgtccttcgccgtagtccttcgcgctgatgatctgcatgttcatcttcctttcctcgttcatcctgcgcagcaggcgctcggacgtcgtgccctggttcgtcacgaccgtcttgccggcgaggtcggggaagtcgcggatgcccgagctcgtgcgcgtgagcaggcgcgtcgtcgcgacgaagaaggtggtcgagaacgcgacctgcgcgtgacgcgccgcaaggttcgtggtgacgccgcattcgagatcgacggtgccgttctgcacgagcgggatgcggttctgcgacgtgacggggatgaagcgcacctgcaggtccggcttgccgatgcgcgccttcacggcggcgatcacgcggtcgcacaggtcctgcgagaagccgatgaccttgccgttcgcgtcgacgtaggagaacggcaccgacgtttcgcggtggccgatcgagatcaggttgctttgccggatcttctcgagcgtgccggcgagcggctccgcggcgaacgaggcgccgcatgcgagtgcgcacgcggcgaagagcagggggcggccgaagcgggcgatgaaccgggcgatgaaacggggctggatgggcatgacgggctccgtggcgagtggtgattcgtatgttgccaaaaacaaaataattgcaacatatgttaagagcaggatcccgccgaccggcccggcgggccacaccgggcatcagggaaactcccgagtcgaaatcggtgaaaaacgggttgtctagacaagttcaggtggctacacttcaaaccactccgaacttgtctagacaggattgctcacatgattacgttgaccccggccacctgaccctcccgcaactgcgccagatcgcacgcgaatccgttcagctggcgctcgatccggccagcttcgcgaagatcgacgccggcgcgaaggccgtcgccgacatcgccgcgaagggcgagccggcctacggcatcaacacgggcttcggccgcctggcgagcacgcacatcccgcacgaccagctcgaattgctgcagaagaacctcgtgctgtcgcacgcggtcggcgtcggcgagccgatggcacgttcgtcggtgcgcctgctgatggcgctgaagctgtcgagcctcggccgcggccactcgggcatccgccgcgaagtgatggacgcgctgatcaagctgttcaacgcggacgtgctgccgctgatcccggtgaagggctcggtcggcgcatcgggcgacctcgcgccgctcgcgcacatgtcggccgtgctgctgggcgtcggcgaagtgttcatccgcggcgagcgggcgagcgcgctcgacggcctgcgcgtcgcgggcctcgcgccgctgacgctgcaggcgaaggaaggcctcgcgctgctgaacggcacgcaggcttccaccgcgctcgcgctcgacaacatgttcgcgatcgaagacctgtaccgcaccgcgctcgtcgcgggcgcgctgtcggtcgacgcggctgccggctcggtgaagccgttcgacgcacgcattcatgaactgcgcggccatcaaggccagatcgacgcggcagcgtcgtatcgcgagctgctcgaaggctcgccgatcaaccagtcgcaccgcgactgcgacaaggtgcaggatccgtacagcctgcgctgccagccgcaggtgatgggcgcgtgcctggaccagatgcgtcacgcggccgacgtgctgctgatcgaagcgaacgccgtgtctgacaacccgctgatcttcccggataccggtgaagtgctgtcgggcggcaacttccacgccgagcccgtcgcgttcgcggccgacaacctcgcactggccgcatcggaaatcggcgcactggccgaacgccgcatcgcgctgctgatcgacgcgacgctgtcgggcctgcccccgttcctcgtgcgggacggcggcgtgaactcgggcttcatgatcgcccacgtgacggccgccgcactcgcgtcggaaaacaagacgctcgcgcacccggcgtcggtcgactcgctgccgacctcggcgaaccaggaagaccacgtgtcgatggcgacgttcgccgcacgcaagctcgccgacatcgcggacaacacgaagcacatcctcgcgatcgagctgctggccgccgcgcaaggcgtcgacctgcgcgcgccgcaccacacgagcccgaagctcgcgccggtgatggaaacgatccgcggcaaggtcgcgcactacgagctcgaccactacttcgcaccggacatcgcggtgatcgcgaagctggtcggcgagcgtgcgttcgcgaaggtcgcaccgttctcgttcgcgtcggaacagtaagcccatgagcgcgccggtctaccaggagatcaaggatttcatcctggcccgcatccacgcaggcgagtgggaggagggcgaccaggtgccgtccgagaacgagctggcgcgcgagttcaaggtggcgcgcatgaccgtcaaccgcgcgctgcgcgagttgacggccgagcaggtgctcacgcgcatgaaggggcgggcacctacgtcgcgcggccgaagtacgagtcgacgctggtggcgatccgcagcatctcggaggaggtcggcgcgcgcgggcatgcgtatcgcgcgagcgtgctcggcctcgacacgatccgcgccgacgaggtgctcgccgacgagatgcaggtggccgtgcgcacgaagctgtttcattcgcaggtgctgcatttcgagaacgacgagccggtgcagctcgaagagcggtgggtgaatccggcggtcgcgccggattacgccgagcaggatttcacgaacacgacgccgaacctgtacctgatgcgcgcggctccgctgcagcgcgtcgagtaccggatcgaagcggcggccccggcgccggagcggcgcgagcagctgcggatggacgacgtcgagccgtgtctggttttacatcggcgcacctggtcgcagggcgtcgtcgcctcggtggcgaatctggcatcccggcagccgttatcgcttcaccgggcatttctgattcctatttgatattcatttccctcgggagcagtcgtcatgaaccatccgaaacacatcgatccccgtctcgatccgacgcgcacgatccgcgcgcgcgcggcagcgagaaagtctgcaagacctggctggccgaagcggcctaccggatgatccagaacaacctcgacccggaagtcgccgagcatccgcacgcgctcgtcgtgtacggcggcatcggtcgcgcggcgcgcaactgggaatgctacgaccagatcctcgcgtcgctgaaggatctcgaggaaaacgaaacgctgctgatccagtcgggcaagccggtcggtgtgttccgcacgcacaaggatgcgccgcgcgtgctgctggccaactcgaacctcgtgccgcactgggcgaactgggaccacttccacgagctcgaccgcaagggcctgatgatgtacggccagatgacggccggcagctggatctacatcggcagccagggcatcgttcagggtacctatgaaacgttcttctcggtcgcgaaccagcacttcaacggcgatccgtcgggccgctggatcctgacgggcggcctcggcggcatgggcggcgcgcagccgctggccgcgacgatggccggcttctcgatgatcgcggtcgaatgcgacgagacgcgcatcgacttccgcctgaagacgcgctacgtcgacaagaaggcgacgacgctcgacgaggcgctcggcatgatcgaggaagcgaagcgcaccggcaagccggtgtcggtcggcctgctcggcaacgcggccgacgtgttcgcggaactcgtcacgcgcggcatcacgccggattgcgtgaccgaccagacgagcgcgcacgacccgatcaacggctacctgccgcaaggctggaccgtcgcgcaatggcgcgaagcgcagaaggtcgatccgcagagcatcgtgaaggtcgcgaagcagtcgatggccgtccaggtgcgcgcgatgctggcgctgcaggcgcggcgcggcgacgctcgactacggcaacaacatccgccagatggcgctggaaatgggtgtcgagaacgcgttcgacttcccgggtttcgtgccggcctatatccgcccgctgttctgcgaaggcaagggcccgttccgctgggtcgcgctgtcgggcgatccggaagacatctacaagaccgaccagaaggtgaaggagctgatccccgacgatccgcacctgcacaactggctcgacatggcacgtgagcgcatcgcgttccagggcctgccggcgcggatctgctgggtcggcgtgaaggatcgttatcgcctcggccaggcgttcaacgagatggtcaagaacggcgaactgaaggccccgatcgtgatcggccgcgaccacctcgacaccggttcggtcgcgagcccgaaccgcgagacggaatcgatgaaggacggttcggacgccgtgagcgactggccgctgctgaacgcgctgctgaacaccgcgggcggcgcatcgtgggtgtcgctgcaccatggcggcggtgtcggcatgggcttctcgcagcactcgggcgtcgtgatcgtcgccgacggtaccgccgaagcgcacgagcgtctcggccgcgtgctgctgaacgacccggcgacgggcgtgatgcgccatgcggatgccggctacgaactcgcgcagcagacggcccgcgaagccggcctgaagctgccgatgctcggccgctgagcatgacggcgctccaccaggcgccggcgaacgcgacgctggccgccgcggtgatccgcgcagcggatctcgtcgcgtcgccatggaagaacggcggcggcgtgacgcgcgaaatcgcggcgttttccccacggggacttccttcggggcgccgccgggcgccgcgctcgacgcgttcgcgtggcgcgtgagcgtcgcggacgtcggcacggacggcccgttctcgcgtttcgacggcgtcgaccgcacgctcgtgctgctgtccggcgcgggcatgacgctcgccgaggaaggcggcgcacgccacgtgctcgacgcaccgctggcccgcgcggatttcgcgggcgaggcggcgatcgacgcgacgctgcacgacggcgcgacgcgcgacttcaacctgatgacgcgccgttcggccgcgcgcggcacgctcgacgtgtggcgcgcaggcgcgcactgcatcgggcacgccgataccgtgctgttgttttgcgcgaccggcgaggtcgccgttgaaatcgacggcacgcgctacacactggaagaaatggacacgttgcggctcgacgggccgcggcgtgcgtttgacgtcgtcgtgagcggtagcggcgcgttgctcgccgtgtcgctcgccatcggcgaacgagactgaacgcatgaaaccgactgtctggcatcacctgaggctgtgtccgcacggccatcctgacgagacgatcgacgacgcggcgatcgccgtcgacgaaaccggcacgatcgcctggctcggcgcgatgtccgcgctgccgcacggttatgcccactggcggcgcgaggatctgcacggcgcgtgggtgacgccgggcctcgtcgactgccatacgcacctcgtgtacggcggcacgcgtgccgacgaattcgcgcagcgcctcgcgggcgtcagctacgaggagatcgcgcggcagggcggcgggatcgtgtcgacggtgcgcgcgacgcgcgcggccgacgagacgacgctgttcgtgcaggccgccgcgcggttgcagccgctgctggccgaaggcgtgaccgcgatcgagatcaagtcgggctacgggctcgacctcgcgagcgaacgcaagatgctgcgtgtcgcgcgccagctcggcgagcgcttcccggtcacggtctacacgacgttcctcggcgcgcatgcgctgccgccggaatatgcgggccgcgcggacgaatacatcgacgaagtgtgcgaccggatgctgccggcgctggccgatgaaggcctcgtcgacgcggtcgacgtgttctgcgaacgcatcggcttttcgctcgcccagaccgagcgcgtgttcgaagccgcgacgcggcgcgggctgcccgtgaagctgcatgcggagcaactgtcgaacgcgggcggcacggcgctcgccgcccgctatcgggcgctgtccgccgaccacctcgaattcctcgacgaagcaggcatcgaggcgatgaaggcggccggcacggtcgccgtgctgctgcctggtgcgtactacttcatccgcgagacgcaactgccgccgatcgagctgctgcgcaagcacggcgtgccgatcgcgctcgcgaccgatcacaaccccggcacgtcgccgctcgaatcgctgctgctgacgttgaacatgggctgcacgctgttccgcatgacggtgcccgaagtgctgcagggcgtgacgcgccatgcggccgcggcgctcggtcgcgcggatcgccacggcgcgctcgaggtcggtcgccaggccgatttcgccgcatggtcggtcggctcgctggcggagctcgcctactggatcggccggccgctgtgcgagcaggtcgtacgcggcggcacgaccgtgtttcgccggatgaatggatagatagccttatgaccgacaccctgttgttcgcagaccatgcgtacctgcccgacggctggcgccgtaacgtgctgctgcgctgggacgcggccggcacgctgaccggcgtgacgcccgacaccgacgccccggcaggcgtcgcgcgtgcggccgggccggtgctgcccggcatgccgaacctgcattcgcacgcgttccagcgcgcgatggcggggctcacggaataccgcgcgaatccggccgacagcttctggagctggcgcgacctgatgtaccgcttcgcgctgaagatcacgcccgacgcgctcgccgcgatcgcgcgctggctgtacgtcgagatgctcaagtgcggctatacgtcggtgtgcgaattccactacgtgcatcacgcgcaggacggctcgcgttatccgcagatcgcggaactcggcacgcgcgtggtcgacgccgcgcgctcggccggcatcggcatcacgatgctgcccgtgtcgtaccagttcgccggcttcggcaacaagccgccgcgcgacgaccagcgccgcttcatcaatacgcccgacggcctgctcgagctgctcgacgcgatgcgtcgcgcggcgccggagcatggcgggctgcgctacggcgtcgcgccgcactcgctgcgcgcggtgtccgagaacgggttgcgcgtgctgctcgacgggctgcccgacgacgcgcccgtgcatatccatatcgccgagcagacggccgaagtcgacgactgcgtgcgtgcctacggcgcgcgccccgtgcaatggctgctcgatcgcttcgatgtcgacgcacgctggtgtctcgtgcacgcgacgcacgtcgacgcggccgaaacggccgcgctcgcgcagcgtcgcgcggtcgccggcttgtgcctgacgaccgaggcaaacctcggcgacggcgtgttcccggccgtcgactatctcgcgcaaggcggcgtgatcggcgtcggctcggacagccacgcgtcggtcgactggcgtgccgagctgcgcctgctcgaatacgggcaacggctcgtgcaccgcgcgcgcaacgtgctggcgagcgacacgcaggcacatgtcgccgatcgcctgttcgacgcgtcgctcgcgggcggcgcgcaggccagcgggcggcgcgtcggtgcgctgcgcgaagggtgccgcgccgactggctcgtgctcgatcccgatcatccggcgatcgccgaacacgacagcacgtcgtggttgtcgggtatcgtgttcgcggagcacggcgagacgccggtgctcgacgtctacacgggcggcgagcgcgtcgtgagcggccgccgccatcgcgacgaagccggcgcgtatgccgactaccgcgccgcgctggcgcaactgctgcgctgacgcgcggcaaccggcgcacgccgcctgcgtgcgccggcagaccttcaacggtgatgcgacatgactgaacaaccggctgtattcacgctgaagcagggcacgctgccgctgctgatctcgattccgcacgcaggcacgtacatccccgacgacatcgccgcgacgatgacggccgacgcgcgtttcgtcgacgattgcgactggcatctcgaacagctgtacggcttcgcggccggcctcggcgcatcgatcctcgtcccgtcgcatgcgcgctacgtcgtcgacctgaaccgtccgcccgacaacgagaacctgtacccggggcaggacacgacggggctcgtgccggtcgatacgttcgacaaggcgccgctgtatccggcgaacgcgctgcccggcaacgacgagatcatgcgtcgccgcgaccgctactggctgccgtatcacgacgcgctgcaaggcgaggtcgcacgcctgaagcgcgagcacggccgcgtgctcgtgtgggaagcgcattcgatccgctcgcacgtgccgcgcttcttcgacggccgcctgccggacttcaacttcggcacgtcgagcggtgcaagtgccgcgccgggcctggcggaagcgctcgccgcgcgcgtgctcgaacatggcggctatacggccgtcgcgaacgggcgcttcaagggcggctacatcacgcgccactacggcgtgcccgaaacgggcgtcgaggccgtgcagctcgagctctcgcagatcacctacatggaagagacgcgcccctacgcgtacgacgaaacgcgtgcggcgcggattgtgccgctattgcggacgctcgtcgaaaccgcgctcgcgcatcgctgaacccgggccgcgcggatgcggcagcgcggcggagccggtgcgtgacggcccgccggcacgcagcgtgccgcaccgatgcaatgcacaacacggcatcgatccacgagatcggtgccgttttttcgtccgggtttcgtctgatcgatgtcgtcatccgcacctgaaaatttgacgcaatttttgggtgatataagctgaatgtcaggaagtcgtcacgcgcgcaccggcggcgggccatcgatcgtggccgcaccgcaccggaatgcgcggcgagacaccttgccgacgtgtcgccgcgcggcattgccgcatgcgcttcatcgcgacacgtgtcctgcattcatccgtcagtcgagtacgatcgtgaaagccgccagcccttcgatacgccggacgcgaagtccgtcggcgggcgcgccgcctcaggccgggccgatccggcatgctgatcgcggcacgcgtgccgcctctttgcgcgaacctcgtttcttcgccatttcccgtcgcggcctgcgccgcttcaacctcgtggctgcccgcgtgttcagcgcggtgcagtgcgacggcagcgcatcgttgttgccctagcgtccctttccacgtccgttccgggccgcaccgcctgttgccgcatcgtccgcgcggcaggatcgcgtttgggcatgcggcgcatcgtggtgcgcgcgggcggtgccggcgcgaaccttcatcgtcccgcgtgcgaacgtgtcgcgcgcgattgccggagagacacccatgcgtgcgcgaccgatcgtagccgtgaccgccgaccgcatcctgcgcggtgcgcatccgaaccacacggcggggagaagtacctggccgcgctcgtcgacggcgcgggcgtgcttgccttcgtgctgcccgcgctcggcgcgcgccagccggccgatgcgatcgtcgcggcggtcgacgggttgctgttgaccggcagttattcgaacgtcgagccgcatcattacggcggtgccgcgagcgcgcccgacacgctgcacgatcccgcgcgcgatgcgaccgcgctgccgctgatccgcgcggcgatcgacgcgggcgtgcccgtactcgcgatctgtcgcggcatgcaggagctgaacgttgcctacggcggcacgctgcatcagcggctgcacgcgacgaccggcttcgacgatcaccgcgagcggccggccgatccgctcgaacggcagtacggccccgcgcacgtcgtgcagttcgcgccgggcggcctgctgcagcggatcgcgcacggcgcacctgaagcgacggtcaattcgctgcacgaccagggcatcgcgcagctcggcgcggggctcgtcgtcgaagccagcgcgcccgacgggctggtcgaggccgtcagcgtgcgcggcgcgcgtgcgttcgcgctcggcgtgcagtggcaccccgaatggcgctacgcggaacagccgctgtcgcgcgacatcttcgcggcattcggcgcggcgtgccgcgcgcgcatgacccatcgcattcatgcggccggcggcgcgatgccgtcgccggccgcatccgacgtcgactgacagaggccgatcatgcaacccgaactgagcgaattcctgcgacagcaccgtatcaccgaggtcgaggcgatcattcccgacatggccggcatcgcgcgcggcaagatcattccgcgcaacaagttcgaatccggcgaatcgatgcgcttgccgcaggccgtgatggtgcagaccgtcaccggcgactatccggaggacggcacgctgaccggcgtgaccgatcccgacatggtgtgcgtgcccgatccgtcgacgatctgcctgattccgtgggccgtcgatccgaccgcgcaggtgattcacgattgcgtgcacttcgacggctcgccggtcgagatctcgccgcgctacgtgctgcgccgtgtgctcgacctgtacaaggcgaaaggctggcagccggtcgttgcgcccgagctcgagttctatctggtcgacatgaacgccgatccggacctgccgctgcgtccgccggtcggccgcaccgggcgcgccgaaaccggccggcagtcgtattcgatcgaggccgtcaacgagttcgattcactgttcgaggacatctacgaatactgcgagatgcaggggctcgatatcgagacgctgatccatgaagtcggcgccgcgcagatggagatcaacttcgtgcacggcgatgcgctgtcgctggccgaccaggtgttcctgttcaagcgcacggtgcgcgaggcagcgttgcgccacaacatgtacgcgaccttcatggcgaagccgatgcaggacgagccgggctcggcgatgcacatccaccagagcctggccgacgcgcgcacggggcgcaacctgttctcgggcgaagacggcgccgtgtcgccgatgttccacagctatctcgcggggctgcagaagtacacgccggcgctgatgccgatcttcgcgccgtacatcaactcgtatcgccgcctgtcgcgcttcatggccgcgccgatcaacgtgcagtggggctacgacaaccgcacggtcggcttccgcatcccgcagtcgggcgcgtcggcgcgccgcatcgagaaccggattccgggtgttgactgcaatccgtacctcgcgttcgcggcgacgctcgccgccggctatctcggcttgtcgcagcagctcgcgccgaccgagccgatcgcgtcggacggctacaacctgccgtaccagctgccgcgcaatctcgaggaggatctcgctgatggcggcgtgcacgccgctcgccggcattctcggcgacaagttcgtgaaggcctacctggcactgaaggacaccgaatacgaagcgtttttccgcgtgatcagctcgtgggagcgcaggcatctgctgctgcacgtctgagcgtgcggcagcgttatccggaggaaacatgaccgatcgaaacgaagccttctcaccgcattcgaccgccgaataccgcgcgctcgacgccgcgcaccacatccacccgttctcggacatgggcgcgctgaaccgcgcgggcagccgcgtgatcgtgaaggccgacggcgtctacctgtgggactcggacggcaacaaggtcatcgacgggatggccggcctctggtgcgtgaacgtcggctacggccgcaaggaactcgccgacgccgcgtatcgccagatccaggaactgccgttctacaacaccttcttcaagaccacgcacccgccggtgatcgaactctccgcgatgctcgcggaagtcacgccgaagggcttcaaccacttcttctattgcaacagcggctcggaaggcaacgacaccgtgctgcgcctcgtgcaccagtactggcgcgtgcagggccagccgcagaagaagtacgtgatctcgcgcaagaacggttaccacggctcgacgatcgcgggcggcacgctcggcgggatgggctacatgcacgagcagatgccgtcgaaggtcgagcacatcgtgcacatcgaccagccgtatttcttcggcgaggcggcggccggcgaaacgccggaagcgttcggcctggcccgcgcgcagcagctcgaggcgaagatcctcgaactcggcgcggaaaacgtcgcggcgttcatcggcgagccgttccagggcgcgggcggcgtgatcttcccgccgtcgacgtactggccggaaatccagcggatctgccgcaagtacgacatcctgctggtggccgacgaagtgatcggcgggttcgggcgcaccggcgaatggttcgcgcatcagcacttcggcttcgagccggacctgatcacgatggccaagggcctcacgtcgggctacgtgccgatgggtgccgtcggcattcacgagcgcgtggcgcggccgatcatcgacaacggcgaattcaaccacggcctcacgtactcgggccacccggtggcggcagccgtcgcggtcgcgaacctgaagctgctgtgcgacgaagggatcgtcgagcgcgtgaagaacgacatcgggccgtacttccagcgccggctgcgcgatgcgctgggcgaccatccgatcgtcggggagatttcgggagcggggctcgtggcaggcgtgcagcttgcgcgcgaccggactcggcgcgagcggttcggtgcgaacgtcgatatcgggacgatctgccgcgacttctgcttcaacggcaacctgatcatgcgcgcgaccggcgaccggatgctgctgtcgccgccgctcgtgattcgcgaggcggaggtcgacgagatcgtcgacaaggcgaaacgtgcgttcgatgcgacggcgcagcgggtggggcacgcacggtaagccggtatctgggtagctgcgtgtggacgcgggcgtcgtcgaatgacatggcgcccgcgtcgctcggagcacgcgcgacgccaaaacgaaagggcctgcgtcgtgagacgcaggcccttgaattctttggtgggcggtactgggatcgaaccagtgacccctgccgtgtgaaggcagtgctctaccgctgagctaaccgcccaaagaagaatcaaattatgtcagagcttttggggttcgtaaagccctttctgcaattttttaaatagccgcaagcaccggttcgcgagccgtgcactcagcccgcgagcgcgggcagtgcatcgatcgacgcgcgcacgtagtcggcgaagcgcagcgcaaccggctcggcggtgccgctgcgcttcagtgcgagcgtgcgcgattcgagcgacgcatccttcagcggccggaacgcgagccggtcgctcttcgcctgctgcagcacgcgcggcaccagcgcgacgcccatcccgaactcgatcatcgacaggatcgtctgccacagccgcgcctcgtggcgaatcagcgggctgaagccggcattcacgcattgcgcgatgatcaggtcgtgatagtgcggcgccgcttcgcgcgggaacaggatgaacggttccgcggccagcgcggcaagcgcgacctgcctgcgccgcgcgagcggatgtgcggccggcaggcagcacacgaacggttccgcatagacaggtaccgattcgacctcgggcgggaagtggccccagtgcgcgtagccgagatcgatctggccgcgctggatcgcctgcacctgcgtgtgcgtgttcatctcgctcagcacgacctcgacgcccgggtagtcggcctcgaagcgccgcaccgcatcgggcagcccgcgatacagcatcgaatgaacgaagccgatccgcagccggcccgcgaggcccgacgcggagcgcaccgtcaggcgttcggcctcggccgcctgcagcagcagccggcgcgcttcgccgagcagcacctcgcctgcgttggtcagcgcgacggtcttgttggtgcgcgagaacagctggacgccgagcgcgtcctcgaacttgcggatatcgaaactcagcgccggctgcgagatgaacaggcgctttgccgcgcgcccgaaatgcagttcctcggcgaccgccacgaagtagcgcaactgcctcagttccatggtgtctcctcgcggcgtcggcatcgataagcgacatctatcgtaccggataaatcctgtattggacgcttatcgatcgcgcgcctacgctctgcggaaggctttgcacgggactggccgggcgccgcggcgcccccgccggccgatgtgcaggcaacccaggagacgcacgcatgaacgacaccgctcgcacgccggacgccggcgcatccaacatccccgacagccggggcctcgatttcttcacggtcgatcccgatctcggcgcgttgctgaagctgcatctcggcgacgcgcactatgccgaactggagcctcggctgcgcgcgctcggcgcacgcgtgtcgggcgaactcgacgaatgggcgtcgcgcgcggacaagcatccgcccgtgctcgaacaccgcaaccggcgcggcgaggccgtgcagcggatcgacaaggatcccgcgtatgtcgcgctcgaacgtgtcgcgtatgccgagctcgggctcgcgtcgttgagccacggggcggaatccgttgcgccgctcgtcaagtacgcgctgacgttcctgttcgtgcaggccgaattcgggctgtgctgcccggtcagcatgaccgattcgctgacgcgtacgctgcgccgcttcggcgatccggcgctcgtcgcgcgctacctgccgaggctcgcgtcgcgcgacttcgacacgctgtaccagggcgcgatgttcatgaccgagcaggcggcgggttccgacgtcggccggatcgccacgcgggcgacgcgcgagacggacgcgcacggcgagaccgtctggcgcctgaccggcgacaagtggttctgctcgaacgcggatgccgatctcgcgatggtgctcgcgcggcccgacggcgcgccggacggcatcaagggcctcgcgctgttcctgctgccgaagacgctgccggacggcacgcgcaaccgctaccggatcgtgcgcctgaaggacaagctcggcagccggtcgatggcgagcggcgagattgcgctcgaaggcgcgcaggcgttcctgatcggcgagatcggccgcggtttccaccagatggccgacatgatcaacatgtcgcggctgtcgaacggcgtgcgcgcggcggggctgatgcggcgcgcgctgaacgaggcgctgcacgtcgccgcgcaccgcgaggcgttcggccgcaagctgatcgagatgccgctgatgcagcgccagttgctgaagatgctgctgccggccgaggccgcgcgcgcgatgttcatgcagatcgcgctgctgctgccgcaggccgatgccggcgacgagcaggccgcgcgctgcgtgcggatcctgacgccgctgatcaagttccgcgcgtgccgcgatgcgcggcgcgtgacgggcgatgcgatggaagtgcgcggcggcaccggctacatcgaggaatggagcgatgcgcggctcgtgcgcgatgcgcatctcggctcgatctgggaaggcacgagcaacatcgtcgcgctggacgtcgcgcgggccgcgcagcgcgagcaggcgctcgacgcgctgcgtacctttctcggcgaccgcctcggcgcggcgccgctgcccgacgcgagccgcgcggcactgcggcgcatcctcgcgcgcgcctgcgacgcgcttgcgcgggtcgcggcggaaggcgacgacgcacgcgtgcggcaggccgcgtccgcgctgtactacgcaagcgcggccgtgctgatggcgtgcgagggcgcgcggctcgcgccggatttccggcgtctcgcgctcgcgcacctggtcgtgcgccacaagctgctgccggtcgacccgcttgcgccggcatcgcgcgacgacgaatccgccgcctgtgctgcgctgctgcgcggcacgcccatcgcgctcgataccgcgctcgacctgctgccggaggtcgaacgatgaccgcctcgcgtggcgcactggacggcctgaaggtcgtcgacctgagccgcgtgctcggcggcccgtactgcacgcaggcactcgccgaccacggggcgacggtggtcaagatcgagccgccggacggcgacgagacgcgcggctggggccgccgttcctcggcgataccgcttggtacttcgcgggcgtcaaccgcaacaaggaagggctcgcgctcgacctgtcgcgcgacgaagggcgcgcgatcctgtggcacctgctcgacgaggcggacgtgctcgtcgagaacttcaagccgggcacgctcgcgcgctggggatggactatgcacgcgacttgcagccgcgcttcccgtggctgatccactgcgcggtgacgggcttcggcgcggacggtccgctcggcgggctgcccggctacgacgcggtgatccaggcgatggcggggctgatgagcgtcaacggcgagcgcgacggcgacgcgacgcgcatcggtctgccgatcgtcgacatggtcacgggcctcaatgcgctcgcgggcatcctgctggcgctcgcggagcgcgagaagagcgggctcgggcaatcgatcgacatcgcgctgtacgactgcggcgtgtcgctgctgcatccgcacctgccgaacttcttcggttcggggcgcgtgccggcgcgcagcggcaacgcgcatccgaacatcgcgccatacgacagctaccgcacggcgaccgtgccgatcttcctcgcgatcggcaacgaccggcagttcgcgcggctcgtcgcgcatctcggcgtgccggcgctcgcgggcgatccacgtttcgtcgacaaccgcaaccgctgcgcgcaccgtcccgagctgaaggccgaactggaagcgcggctcgccgcgcacgcatgcgagccgctcgcgcgcgacctgatggcggccggcgtgccgtgcgggccggtgcgaacggtggccgacgtcgcgcacgatccgcatgcgctgcaccggaacctgttcgtcgagatcggcgcatatcgcggcaccgcgtcgccggtgaagctgtcgcgcacgccggctacctatcgttcgccgccgcccgcgctgggcggcgacacgcgcgcggtgctcgatcgcctcggcgtcgatcccgcgctccagcagcaattgctcgacgccggcgtgctgagggaagccccggctgacacgacgccgccggccggcggcgccatgccggccacccgggaaaggcgcgcggcagccgcgccccggaaacacaaacatggagacattgatgagccgtcagccatccccgtccgccgcgcagcagccgcggcccggccgcgccgccttcgcggcgttcgtcggcaccacgatcgagtggtacgacttctacatttacggcaccgccgcggcgctcgtgttcggcaaggtgttcttttcgagcaggatggatcccggcgtcgcgacgctgcttgcgttcgtcacgttctgggccggcttcgccgcgcggccgctcggcggcatcgtgttcgggcatctcggcgatcgtgtcggccgcaagaccgcgctcgtgatcacgctggtgatgatggggctcgcgacgaccggcatcggcctgctgcccggttatgcgcggatcggtgtatgggcgccggccggcctcgtcgcgctgcgcgtgctgcagggcatcgcggtcggcggcgagtggggcggcgcggtgctgatcgcgagcgagaacgcgccgaagcatcgcagcatcctgtacgcggcgttcgcgcagcagggttcgcccaccggcaacctgctggccacggccgcgtttttcgcgctgagcgcgctgccgacaccgtcgttcctgatgtggggctggcgcattccgttcctgctgtcggccgtgctggtgatcatcggcatggtgatccggctgaggctcgaggagtcggccgacatgcagcgcgtgctcgcgcgcaagcgcaccgtgaagctgccactgcgcgacgtcgtgcgcgatcactgggtcgtcgtgctgctcgcggccggcacgctgccggtgatcaacgtcacgtacttccgcagcacgttcgcgctgtcgtgggcgacgaaggaactcggctacgcgcagggcacgtttctcggcatcctgtcgatctcgctcgtcgtgcagttcctgatgcagccggtcggcgcgtggttcgtgtcgaaggtcgacatgcgccgcgcgatgtgctggatcctgattccggaaatcgtgctgatgccggtgatgttccatgcgctcgcgacgcgttcgtattgggtcgccgtcgcgggcatgtgcatctcgacgattccgtcggcgatgttctacggtgcggtcggcggcgtgctggcgcgcgtgttcccggcgaacatccgctacacgggcctgtcgctcgcgtatcagctgagcgcgctcgtcgtcggcggcggcacgcccgtgctcgcgcaggcgatcctcaacacgaccggcagcatcgtcggcgttgcggtcgcgtcggggctttacgcgctcgtgtcgctcgtgtgcatgctcgcactgctgaatcgcaccgggtatcgcgcggacgaactgtcgacggccgaacgcagcgatgcggccgaatggggcaccgaaggcggcagcacggcacccgcggccgacgggagcgcgcagccgggcgacggcggtgcgctgaagccggccggctgagcggcacgccatgccgccgcgcgggaggcgggaacgccccgagcgcatgtcgccaaagaaaacggcaccgcgcgaaacacggtgccgtctttccggcacgcggccggcaggctgccggccgcgcgcatcgcatcatcagccttccgtcggcggcacgtagccggacgcctggtccgcgccgtcgccgaagaagtacttctcggtctgcttcatcaggtactggcgcgcgcgcgggtcggccatgttcaggcggttctcgttgatcagcatcgtctgctgcttgagccagccctgccacgcttccttcgagacgctctcgtaaatgcgcttgccgagttcgcccggcagcggcgggaaatcgaggccttcggcttccttgccgagcttcgcgcattgaatcattcgagccatcgtgtacttctcctgtaatcgaactggggagggcagtcgtgcctgcgctcagagctgcttcatcagcacgagcgacttgcgctgccagttatagagtttgcggcggtcttcgggaggtcgtcgacgctgaccttgacgaagccgcgcttgaggaaccagtgctcggtgcgcgtcgtgagcacgaagatgtgcgtgaggccgcgcgcgcggcgcgctgctcgatgcgcttgagcaggcgttcgccgtcgcccgagccctgcgcttccggtgcgaccgtcaggcacgccatctcgccgatcttctcctgctggtacggatacagcgccgcgcagccgaacagcacgccatcgtgctcgatcaccgagaagtggtcgatgtcgcgttcgatctggtggcggccgcggcgcaccagcgtgccgtccgactcgagcggctcgatcagcgacaggatgccgccgacgtcgtccggcgtcgcttcgcgcaggctctcgaggttctcgtacgagatcatcgtgccgacgccgtcgtgcaggaacagttcgagcagcatgctgccgtcgagcgactgcgggatcaggtgggccgggtcacgccgccgcggcatgcgcggatcgagtgcttcaggaagaacgcgtcgtcgccctggacgttgccggaatcgagcagctcggcggccgcgtcgagcgacatttcgcgcaccagcccgccttcgtcgtcgacgatgccgggcgcttcggtcaggaagatgatcttgtcggcgcgcagtgcgatcgcggcggccgacgcgacgtcttccatcgacaggttgaacgcttcgccggtcggcgagaagccgagcggcgacagcagcacgagcttgcggctcgcgagagaatgacggatcgactcggcgtcgatcttgcgcacgatgcccgtatgcgcgaaatcgaccccgtcgagaatccccaccggccgcgcggtcacgaagttgcccgacacgacgctgatgtgcgcgtgcgccatcggcgagttcggcagaccctggctgatcgcggcctcgatgtcgagacgcacttcgccggccgcttccttcgcggattcgagcgcgcgcgcatcggtgatgcgcaggccgtgcgaaaactcggattcgacaccgtgcaggctcagctgctcctcgacctgcgggcgcgaaccgtgcaccagcacgatctggatgcccatcgcctgcagcagcgcgatgtcggacacgagcgcgttcaggagcccctgctgcaccacctcaccgccaaaccccacgacgaacgtgctgttgcggaacttgtggatatagggcgcgacggagcgcatccagtcgacgaactgcgcgtgactggcggccgaatcgtcggcggccggcggcgtcgcggcgccggtctgggcgggggaggtcggtttgggaattcatgggcgggattataatgcgcccccatgtcgaatgtttctaaaagtcccgcgccgacgcgggccaatacgccgtcggcccggcacccggatggtgcggccgacgcacgcgagcagcagggccagccagcgcgccagcagcaggaaaagcaggcgggcaaaccggcagacgcgccgcgcgggcctcgcggtgacgaacggcgcggcgatgcgcgccagtccgccgcgaagggcgcaccccaggcaacgggcgagcgttccccgcgccgcgagcggccgccgcgcgccgtcgtcgcgccgaaccccgtcccgccgatcacgtaccccgaaagcctgcccgtgtcgggcaagcgcgacgaaatcgcacgcgcgatcgccggtcatcaggttgtcatcgtctgcggcgaaaccggctcgggcaagaccacgcagctgccgaagatctgtctcgatctcggccgcggcctcggcgccggcggcacgggcctgatcggccatacgcagccgcggcggctcgccgcgtcgtcgaccggccggcggatcgccgaggaactcggcacgccgttcggcgaggtggtcggctacaaggtgcgctttaccgacaatctcgcgccgggcgcgtccgtcaagctgatgacggacggcatcctgctcgccgagacgcagaccgatccgctgctgaaggcgtacgacacgctgatcatcgacgaggcgcacgagcgcagcctgaacatcgacttcctgctcggctacctgaaggaaatcctgccgaggcggccggacctaaaattgatcgtcacgtccgcgacgatcgacgccgatcgcttcgcgcgccatttcggcaccgacgagcgtcccgcgcccgtgatcgaggtgagcgggcggctgtatccggtcgagatgcgctaccggccggtggccgaggatcgcccggccgtgaaaaatgccgaaggcacgggcggccgcgatcgcgtgaagaccgcgcgcgaagccgagcgcgacctgatggatgcgatcgtcgacgcggtcgacgaactgtgccgcgaaggccccggcgacgtgctggtgttcctgcccggcgagcgcgagatccgcgaggcggccgaggcgctgcgcaagcatcatccgccgcacaccgagatcctgccgctgttcgcgcggctctcggcagcggaccaggacaaggtgttcaaggcatcgaacgcgcgccgcatcgtgctcgcgaccaacgtggccgaaacctcgctgacggtgccgggcatccgctacgtcgtcgataccggcctcgcgcgcgtgaagcgctattcgtaccggaacaaggtcgagcagctgcaggtcgagtcgatctcgcaggccgccgcgaaccagcgcgcgggccgctgcggccgcgtggccgacggcgtctgcatccgcttgtacgaggaaagcgactaccaggcgcgtgcgcgcttcaccgatccggaaatcctgcgctcgtcgctcgcgtcggtgatcctgcggatgaagtcgctgcacctgacggcgatcgaatcgttcccgttcctcgagccgccgcccggccgtgcgatcgcggacggctaccagttgctcaacgagctcggcgcggtcgacgacgacaacgcgctgacgccgctcggccgcgaactcgcgcggctgccgctcgacccgcgcgtcggccggatgattctcgccgcgcgcgaccagcagtcgctgcgcgaggtgctgatcatcgcgagcgcgctgtccgtgcaggacccgcgcgaccgcccgatcgaagcgcaggagcaggccgaccaggcgcaccgccggttcgccgacgagcgttccgagttcctgcagtggctgaagatctgggcgtggttcgaagaggcggtcgcgcacaagaagtcgaaccgccagctcgtcgacgcatgccggcagaacttcctgtcgcacctgcggctgcgcgagtggcgcgacgtccattcgcagctgctgaccgtcgtgcgcgagcacggctggcggctcaacgaagccgaggcgacgtacgaacaggtccatctggccctgctgacgggcctgctcggcaacctcggcctgaaggccgatgacgatccgcactatctcggcgcgcgcgggatcaagttctacctgtggccgggctccgtgctcgcgaagaaggccggccgctgggtgatggcggccgagctcgtcgagacgagccggctgtacgcgcgctgcctcgcgaagatcgagccggagtgggtcgagaagatcggcgcgcacctgctgaagaaatcgctgtcggagccgcactgggagaagcgcccggcgcaggtcagcgcgtacgagcgcgcgacgctgtacgggctgccgatctaccaccgccggcgcgtcgcgttcggcaagcaggatccggcgcgggcgcgcgagctgttcatccgcggcgcgctggtcgaaggcgaattcgacacgaagctgccgttcttcgcgcacaaccgcaagctgctcgccgacatcgagcagctcgagcacaagtcgcgccggcaggacgtgctggtcgacgacgagctgatctacgcgtactacgaccaggcgattccggcgggcatccacacgggcgccgcattcgagcgctggtatcgcgacgaggtgaagaagggcggccagcccgaggacaagcagcggctgctgtacctgtcgcgcgacgacctgatgcgccacgaggcggccggcgtgacgaccgagctgttcccgaagcgcgcgacgatggccggcgtcgagatggcgctcacgtatcacttcgagccgggcacgccgcgcgacggcgtgacgctcgcggtgccgctgtatgcgctgaaccaggtcgacgcgcgccgctgcgagtggctcgtgccggggatgctgaaggaaaaggtgcagttgctgctgaagtcgctgccgcagaagctgcgccggcactgcgtgccgctgcccgagtacgcggccggcttcgtcgagcggatgggccgcgagcgcttcggcgcgggcggcctcgtcgaggcgctgatcgccgacgtgcgcggcgagacgcaggtcgcgatgaagacggccgatttcaagctcgagacgctgcccgcgcacctgttcatgaacttcaaggtgatcgacgagcacggccgccagctcgcgatggggcgcaatctcgcgcagcttcgccaggagctgggcgcgcaggcgcagcagcagttccagaagatcgcggcggcgtcgacgatcgcggctggcggggagggcgatgcgggtcagccggtcggccaggtgccggcggcggctggtccggccggcgcacccggccgcggcccgaagcccgcgaagggcgcggcgccgcagacgtccgctccggcggaagccggtgcgacggcgctgtacgagaacctgacgacgtggaatttcggcaagctcccgagctgctggaaatccgccggcgcggccagacgctgtacggctacccggcgctcgtcgatcgcggcacgcattgcgacgtcgaggtgttcgattcgccggaggaggccgcgcgcatccaccgggccggcctgcggcggctgttcgcgctgcagctgaaggagccgatcaagttcctcgagaagaacctgccgggcctgcgcgagatggcgatgcagtacatgtcgctcggcacgcaggacgaattgcgcgaccagctgatcgacacggcgctcgaccgcgcgtgcctgcaggacccgctgcccgacgacgacgcgagcttccacgcgcgccgtgacgagggccgaagccgcctgaacctgctcgcgcaggaaatcgcgcggctggtcgggcaggtcctggccgaatacgcggggctcgtgaagaagctcgcgcaggcgaaaccgttcgcgcaggcgcatgcggacctgcaacagctcgccgcgctggtcggcaagcgcttcgtgatcgatacgccctacgcgcaactcgcgcacttcccgcgctacctgaagggcatcgcgctgcggatcgacaagctgaaggccgatccggcgcgcgacgcgaagcagtcggccgacctgctgccgctcgcccagcagtaccagcgcgcggtgtcgcagcgcggcggcgtcgccgatccgcggctcgcggaattccgctggctgctcgaggaattgcggatttcgctgttcgcgcaggaactgcgcacgccgatgcctgtctctgtcaagcgtctgcacaaggtctgggagtcgatgcagcgctagcgcaacatcggcttcccgggctccgcgccggcggcgggccccggccggccgcgcggcgcttgccgggccgcccggccgggcacgccgccgcgtgcgtcgaagtggcgcaatgccggcccaggtcaaccggccgggccggttgaacgttttacaatgacggttgttccacgacgtgagtcttcatgcgcactttcctttccctcggccgcacgctcgcgctggccgccgccgtgctggcgcccgccgcccacgctaataacgtgattatcctcaattcggccgaagcgacgctttcctgatcgaccagcagacccgtcaggtcgtcggcacgatgccgaccggcaaggaaccgcaccatctgatggcaacgcccgacaattcgtcgctgatcgttgcaaattcggtctcgaacagcctgatgttcctcgatccgaagacgggcaagctgcagcgcaccgtcgaagggatcgacgatccttaccagctcggtttctcgcccgaccgcaagtggttcgcggccgccggcctgcgcctcgaccgcgtcgacatctacggctacgacggccgcgacctgaagctcgtgaagcgcgtgccgctcgaagtcatgccgagccacctcgcgttcacgaaggacagcaagacgctgctcgtgtcgctgcaggtgtccggcgagatcgcggcgatcgacctgccgacgcagacggtcaagtggaagatgaaggtcggcaaggtgccggccggcctgtggctcacgccggacgacaagtacctgctcgtcgggatgacgggcgcggactacgtcgcggtggtcgactggcgcaaccagaaggtcgtcaagcagatctacaccggcaagggcgcgcacaacttccgttcgctcgccgacggcacccacgtcgcggtgacgaaccgggtcgcgaacacgatcagcatcatcgacgagaacacgctcaccaacgtcggcgacatcaccggcctgctgccgggcccggacgacatggagctgtccgccgacaagaagacgctgtgggtgacgttccgcttcgcgaagaaggtcgggatcatcgacctggcgtcgcgcaagctggtgcagacgatcgccgtcggccgttcgccgcacgggatctacttctacgaccgcgcgccgtggcgcgccgcgaacggcgcgtgacgggcggggagaacgatgctgcacctgatcgatgcgttcgtatcggacatccagacctggctgtacgtcgacgtcgtgcagccgctcctcttcaagttcaacctgatggactacgacgaggacacctacgacgcgctgtactgggtgatcgtcggcgcgctgcagatggtgctgatgttcgtgctgctgcgccgctcgaggcgctgcggcccgtcgagcgctggacgaaccgccgtgccgtgcgggtcgacgtgatctacaccgcgatcgcgaagctcggcatctattcgctgttcttcttcttcgcgctgcaaccgctgttcgacaacttccaggcgtggctgcgcctgcacgggtcgcgaacgtcaacctcgactacctgtggccgggcgtgacctcgaagccgatcgtcgcgttcgcgatctatctcgtcgtgctcgatttcgccggctactggtatcaccgctggcagcacaagttcggcgtctggtgggaactgcacgccgtgcatcacagccagcgccagatgtcgctgtggtgcgacgaccgcaaccacgtgctcgacgacgtgatccagtcgtgcttcttcgcggcgattgcgctcgtgatcggcgtgacgccgtcgcagttcgtcgtgctgaccgcgttcaccaacttcatgcagagcattcagcacacgaatgcgcgcctgtcgttcggctggctcggcgagcgcctgttcgtgagcccgatcttccaccggcgccaccacgcggtcggctacggccacgaaggcacgaagtacggctgcaacttcggcgtgctgttcccgtggtgggacatgatgttcggcaccgcgtcgtggaaccgcacggtcgagccgaccggcatccgcgaccaggtcgagggcgtgtcctacggcgaaggcttctgggcgcagcacggcctcgcgttcgtgcggatcttccggcgcctgttccccgccaagcgcggcgcggcgtcggcctgatccggccattcccacgttgagcggctctccacgcggcccgcatgtgctttggcgcatgcgggccgcgtggtttatcctttcccgttttctccgtcgatacaggctcgcatgaacgacttgctgcgttccttcgtccgggcattcgcgagcgcactgcatccgcgcatgctctggctcaccctgatgccgtttctcgtctcggccgtcctgtggggcgtcgtgctgtggttctcgtggcagacgctgctggacctcgcacgcggcgcgctcgacggcttcgtgctgacggccctgctgtaccgcgcgttcgacgcgatcggcatgtcgcagctgcatgcggtcgtcgcgccgttcgtggtcgtgtcgctcgcgattccgctgatcgtgctgaccgtgctgttgctgatcgcgacgatttcgatgccggtcgtgatcaagcacctgtcgaaccggcagttcgcggcgctcgagccgaagcggggcggcaccttcttcggcagcgtgttcaattcgctgtgggcggcgctggccggcgtcgtcgtgctggtcgtcacgatcccgctgtggctgattccaccgttcttcgcgctgctgccgcccgtgatctggggctggctcacgtaccgcgtgatgacctacgacgcgctcgcgctgcacgcgagccgcgacgagcgccgggcgctcgtgcgccggcaccgctggccgctgatcggcatcggcgtcgcgaccgggctgctcggcaccgtgccgaccttcgtgtgggtatcgtcggtctggatgatggtgctgttcccgttcgtcgcggcggccatgatctgggtttacgctttcatcctcgtcttctcggcgctgtggttcgggcattactgcctgcgcgcgctggaggacctgcgtgcgagttcgcgcgccaccgcaatcgacatggggcaggcatgagcatcggcatcatcatcatcggcgacgaaatcctttcgggccgccggcaggacaagcatctggcgaaggtcatcgagctgctcggcgcacgcggcctcgcgctcgactgggccgaatacgtcggcgacgatccggcgcgcatcacggcgaccctcgcacgcgcgatcgcatcgggcgacatcgtgttctcgacgggcgggatcggcgcgacgccggacgaccacacgcgccagtgcgcggccgccgcgctcggcgtgacgctcgagctgcacccggaagcgaaggtgctgatttcggagcggatccgcgaaacccacaccgacccggccacgccggtcgatttcgattctccggagaaccagcaccgcttcaacatgggcgtgtttccggtgggcgcgacgatcatcccgaacggctacaaccggattcccggtttctcggtcggcgacctgcatttcgtgccgggtttcccggtgatggcgtggccgatgatcgaatgggtgctcgatacgaagtacgcacacctgcatcacgcgacgccgcacgcggagcgttcgctgtacgtgttcgagctgccggaatcgacgctcacgccgttgatggagcgcatcgagcgcgatttcccgggcgtgcgcgtgttcagcctgccgagcgtgggcgatgcggagcgtggcgggatcttcgcgcgccgtcacatcgacctcggcgtgaagggcgagccggaagcggtcgcggccgcgtacgtgaagctgcgcgagggcgtgcacctgctcggcggcgacgtcgtcgaagccgagacgtcgcgcgcctgagcggcgcgccagccggccgcacaaaaaccacgggccgcgcaacgcggcccgtcatcggcatgtcatcgcccggctcgacgatgaggctgtcgtcaccggcgggcgcggcgcgccgtcaggcgccgatccacggcagtttccggaagcaccagccgtcgaccgtcttgcggtggccttcggcgtccttcgcgccctcgaagccttcgagcaggtcgaacgccttcgtgaagccggcctgcgtggaggcgaccgcggcgagcttcgagcgcgcggcgctgcggcacaggaacaggatggggtatcggccgggagagccgccttcagttcgttgacgaattcggcgttcggcacgccgcccgggtagcgcgtccattcgaggtgcagatactggccgtcgccgacgagcgggcggccgatccagtcgagttcggcgcgggtgcgcacgtcgacgaggcgtgccgacggatcgagctgcagcagttcgaaggcttcggccggcagcagcgccccggcgtagttgagcgcgccttgggcgcggcgttcgtcggccttcgcgtaaagctggtcgagcgtactcatggcagggagtctccgtatcggtcaaacgagcattctagcgcggcgtcgcggcacggatggccgcgtgcggtgcggtgcacgcgtggcccacgtgttcaccaaaaagtgcagaatggcacgcatgcaccagaatgattccttggttgcggcgggctgccggaattgcaccattgcggtgctttcggcgagcgaccagtgcggcgcaaggccccggaatcgcgcagcccggccctgtcgtggcgagccccggcgcgatttgcgcccgtcgttcgcaaaggtggcacggaagctgctatatagaattcggtcgaatcggggcgcgctgcgccaaagcaagaccccggtcagctcgataaacgaggcggttcccagtccgccggaattgttctaatcaggagaagaggttatgagtaaaaccgtcgccgacgtcatgcagctcgtgaaggacgaggacgtcaagtttgtcgatttccgcttcacggatacgcgcggcaaggagcagcacgtgtcggtgccggtttcggcgtttgacgaagacaagttcgaaagcggccatgcattcgacggctcgtcgatcgccggctggaagggcatcgaggcgtcggacatgctgctcatgccggacccgagcgccgctttcgtcgacccgttctatgaagagtcgaccctcgtgctgacctgcgacgtggtcgagccggccgacggcaagggctacgagcgcgatccgcgttcgctcgcgaagcgcggcgaagcgtacctgaagagcacgggcatcggcgacacggcctacttcggtccggaaccggaattcttcattttcgactcggtccagtggaacacggacatgtcgggctgcttcgtgaagatcaactcggaagaagcgccgtggtcggcaggcaaggaattcgaaggcggcaacacgggccaccgtccgggcacgaagggcggctacttcccggtcgcaccggtcgacacgttccaggacatgcgttcggaaatgtgtctgctgctcgaacagctcggcattccggtcgaagtgcaccaccacgaagtggcgggccagggccagaacgaaatcggcacgaagttctcgacgctggttcagcgcgccgactggacgcaatggtcgaagtacatcatccacaacgtcgcgcactcgtacggcaagacggcgacgttcatgccgaagccggtcgtcggcgacaacggttcgggcatgcacgttcaccagtcgatctggaaggacggccagaacctgttcgcgggcaacggctatgccggcctgtcggaactggcgctgttctacatcggcggcatcatcaagcacgcccgtgcactgaacgcgatcacgaacccgacgacgaactcgtacaagcgtctggtcccgcacttcgaagcaccggtcaagctcgcgtactcggcgcgcaaccgttcggcatcgatccgcattccgcacgtgtcgaacccgaagggccgccgtatcgaaacgcgcttcccggatccgatggcgaacccgtacctgtgcttcacggcgctgatgatggccggcctcgacgggatccagaacaagatccatccgggcgaagcagcggacaagaacctgtacgacctgccgccggaagaggatgcaaagatcccgaccgtctgcgcgggcctcgaccaggcactcgaagcgctcgacaaggatcgcgagttcctgacgcgcggcggcgtgttcacggacggcatgatcgacgcgtacctcgcgctgaaggagcaggagctggcgaagttccgcatgacgacgcacccgatcgagttcgagatgtactactcgctgtaatcggcgatggcgcttcgattcagcgccgttttgccggttcgttcccgccgcgcggttggcggcgggggcggcggagtctgaaaggggcggcgttcagccgtccctttttgttccggtgattttccttttctggcccgttgaggcgcgacaagcacgcagatggttctgaagaatctgatcaaggcgaaaacggggcagcccgagcgactgacggacgacgagcggctcgcacgctcgggcctgctggcagggctggaagcgctgccgacggtcgtgctcgtgctcgaccgcaagacgctgcggatcgcgttcgcgaacccctccgcggaggcgatgctcgacatctcgcgccggcagctcgcgcagcggccgtggggcgagatctttccgaacgcgaacgaactggcgtcgacgatcaccgcgatcggcgaggagcgctttcacgcgacgcacctcgataccgtgctcgaccggcccggccgcgaaccgctgcacgtgcacgcgatcgtcggcttcctcgagaccgcgcccgatttcgtgctcgtcgagctgttcgagaacgaacggcagtcgcgcaccgatcgcgaggagcgcatccacgacctgaccgcggtcaacaagcaactgatccgcaacctcgcgcacgagatcaagaatccgctcggcggcattcgcggcgcggcccagctgctcgaattcgaactcggcgagcgcgagcgcggcgagttgcgcgaatacacgcaggtgatcatcaaggagtccgaccgcctgcagacgctcgtcgaccggttgctggagccgcaccggcatccgcacatcgtcggcgacgtgaacattcatgaagtatgcgaacgcgtgcgcgcggtgatgctcgcggaattcccgcgcgggctcacgatcgagcgcgactacgacgtgagcgtgccggacctgcgcggcgacaaggagcaactgatccaggcgctgctcaacatcgtgcgcaacgcggcgcaggcgctgcgcgaacggatcgcgcagggcgacgcgaagatcgagttgcgcacgcgcatcgcgcgcaaggtgacgatcgcgaagcgcctgtaccggctggcactggacttgcacgtgatcgacaacggacccggcatcccggaagacatccgcgaccggatcttctacccgctcgtgtccgggcgcgacgacggcagcggcctcggcctgacgctcgcgcagacgttcgtgcagcagcacgacgggacgatcgaggtcgaaagccggcccggacgtaccgaatttcagatcctgctgccgctcgatcattgagcgacggcatggcgattcaccggattcaccaatatctgaccgacctatgaagccgatctggatagtagacgacgaccaatcgatccgctgggtgcttgaaaaggcgctcgcccgggacagcttcgcgacgaagagcttcgcgaacgtgcgcgacgcgctggccgcgctcgaccacgagacgccgcaggtgctcgtatccgacatccggatgccgggcggctcgggcctcgagttgctgcaggcgatgcacgagcgcctgccgggcctgcccgtcatcatcatgacggcgttctccgatctcgacagtgccgtcgcggcgttccagggcggcgcgttcgaatatctcgcgaagccgttcgacgtcgacaaggcggtcgagctgatccgccgcgccgtcgaggaaagcctgcgcggcggcgtgccgcaggacgagcgcgtggccgaggcgcccgagatgctcggccaggcgcccgcaatgcaggacatgttccgcgcgatcggccgcctgtcgcactcggccgcgaccgtgctgatcaccggcgaatcgggcaccggcaaggagctcgtcgcgcgtgcgctgcaccgtcacagcccgcgcgcgaacgggccgttcatcgcgctgaacaccgcggcgatcccgaaggacctgctcgaatccgagctgttcggccatgagcgcggcgcgttcaccggcgcgcagtcgactcggcagggccgcttcgagcaggccgagaacggcacgctgttcctcgacgaaatcggcgacatgccgttcgacctgcagacgcgcctgttgcgcgtgctgtcggacgggcagttctatcgggtcggcgggcacaacccgctgcgcgcgaacgtgcgcgtgatcgccgcgacgcaccagaatctcgaatcgcgcgtgcggcagggcctgttccgcgaagacctttaccaccggctcaacgtgatccggctgcggctgccgccgctgcgcgagcgcagcgaggacatcgcgctgctcacgcgccacttcctgcagaagagcgcgcgcgatctcggcgtcgagccgaaacgcgtgtccgacgaggcgctggcctacctgacgtcgctcgcgtttcccggcaacgtgcgccagctcgagaacctcgcgaactggctgaccgtgatggcgcccgcgcagacggtcgagatcaaggacctgccgcccgacctcgtgccggccggcgcgccggtcgtcgctgcgggtgaaggtgcgggcacgcacgtcggtggtggcgatacggcactctctgcaccggtgacgggcacggcgccggtggcgtccgcgcctgtcgcggccgcgccgaacggcagcgcgccggccggctatcctgtgtgggagcatggtttgcgcaccgaggttgcgcggctgttgcgcgagaattcggccgacgtgatggacgaactcgcacgccgcttcgaggcggccgtgatccgcgaggcgctcgacttcacgcgcggtcgcaaggtcgaggccgcggagcgcctcggcatcggccgcaacacgatcacgcgcaagatccaggaactccatctggagccctgagcacgatttgcggcatgcgcgggcatcgcgcatgccgcgatcggacataatcgcggtttgcacgccgtttgccattccgcccatccgcaatgtccgattccttccgctggcccgccggggccgacccgttccgtttcctcgaagcgctcgacagcaagcgcgcccgcacgtgggtcgacgagcagaacgcgcgcacgcgcgccgcgcgtgacgacgatgcctatcgcgcgctcacggcgcgcctcgcgaaagcgtacctgccgcgcgaacgcccggtgattccaacccgctggcgcgactgggcctacgacctgtggcaggacgatctccatccgaaggggctgtggcgccgcacgcgctgggacgactggcgtgccggccggccggcgtgggaaacgctgctcgacgtcgatgcgctcggcgcggaggagggcgaatcgtgggtgttcgagcaggacgcgatcctgtacccggacggcgatcgcgcgctgctgtcgctgtcgccgggcggtgccgacgcggtcgtcgtgcgcgaattcgatctcgtcgaacgtcgtttcgtcgacggcggcttcacgatcgacgagccggggcatcacacggtcggctggatcgatcgcgataccgtctacgtgagctgggatcgcggcgacgcgcatgccaccgcggccggctatccgtatgaagcgcggcgctgggtgcgcggcaccgcgcttgccgatgcgcctgtcgtcttcagcggcgaacccgacgacatcagcgcgggcgcggggttcgatccgatcgacaaccgccacgtcgcgtggcgcagcgtcgacttcttcgacgcgcatgcgtaccggctgaccgatgcgggcgagtgggcgcgctacgacgtgccgccccatgtcgaggtcgggttctgggaaggctggctcatgctggagccgcgcctcgactgggattgcggcggcgtgcgccatgtgggcggctcgctgctggcgatccgcgagcaggcgttcctggccgggtcgcgcgaactcacgacgctgttcgcgccgcagccgacgacgtccgcgtgcacgtggacgcacacgcgcacgacgctgatcgcgagctggctcgacgacgtgcacaaccgcacgatgctgtggcaaccgcgacaggtcgacgacggtacgtggacatgggatgcgcggccgttcgagtgggcgggcgacgcgcagatcgacgtcgagcccgtcgagtcgacgctgaacgacgaggtgtacgtcgacgtcgacacctatctcgatccgcctgaatgctggctggcggatctggccgaccgcgcggacgatgcgtcgtcgcgccgcgtgctgctcgaccggccgccggtgcagttcgacgcgacggggctcgtcgtgcgccgcgcgagcgcgcgctcgcaagacggcacgatggtgccgtacacgctgatcgggccgcgcgatgcactcgatccggccgaaggcgccacgcgcgtcgcgcggccgtgtttgttgtcgggctacggcggttttgcgatcccgaacctgccgggctacagcgacgcgttcggcatcgggtggctcgagcgcggcggcgtgatggcgttcgcgcacatccgcggcggcggcgagttcgggccgcgctggcatgtcgacgcgcagcgcgaacaccgccagcgctcgttcgacgatttcatcgcggtggccgaggacctggccgcgaccggcgtgacgagcgccgcgcagctcggcatcgagggcggcagcaacggcgggctgctggttgccgcgtgcatggtgcagcggccggagctgttcggcgcggtgctctgccgcgtgccgctgctcgacatgcggcgctatccgaagctgcacgcgggcgccgcgtggctcgacgaatacggcgacccggacgatccacacgaaggtgcggcgctggccgcgtattcgccgtatcaccgcgtgcgtgaaggcgtcgcgtatccgccgttactgctgacaacgtcgacgcgcgacgaccgcgtgcatcccgcgcatgcgcgcaagatggccgcgcgcatgcatgcgctcggtcatgaacgggtgtggtattgggagaacaccgacggcggccacggcagtgccgacgatctggaacgcgcggaagccgacgcggcggaattcgggttcctgtgggcccatctcgggccggcgcccgcgcggcgctgaacgcgcgcgggctgcccggtcagccgacgaccgcgaccacgggcgtgtggtcggacggctgttcccacgtgcgcggcgtgcgatcgacctcgcacgacgtgcaggtttgcgcgagcgccggcgacagcagcacgtggtcgatgcgcagccccgcgttgcggcggaacgccatcatccggtagtcccaccatgtgaaggtcttctccggctgttcgaagcggcggaacgcatcgacgaagccgagttcgatcagttgcgcgaagtgggcgcgctcctgcggcgacacgaggttctggccttcccatttcgcggggtcgtgcacgtcgcggtcttccggcgcgatgttgtagtcgccgagcagcgcgagcttcgggtagcgctgcagctcggtgcgcagccacgcctgcagcgcgtcgagccattgcatcttgtagacgaacttgtccgagtcgggcgcctggccgttcgggaaatacgcggacacgatgcgcacgccgtcgaccgtcgcggcgatcacgcgctgctggggatcgtcgaagcccggaatgttgcgtacgacgtccgattcgtcgacggacagcgtgtcgcgcgcgaggatcgcgacgccgttgtaggtcttctggcccgtgaaccagctgcggtagccggcggcttcaagatcggcgcgcgggaatttctcgtccggcagcttcagttcctgcaggcacagcacgtcggtgccgctttgcgcgagccagtcgagtacgtgctgcttgcggacgttgagcgagttgacgttccaagttgcgattttcatgaacggggagtgtgcgtgcggggtaaatgcgaaggccgccatcttaccgcgagcacgcggtgcgaacgcgcccgtcgtgcggggcggggcggtgcctcgcaccgccgtctcgggaatcgggaagaaattgtgacaaaagtattgacgtgagtacttcctcaccctataatttatttctctgacgcggggtggagcagtctggcagctcgtcgggctcataacccgaaggtcgtaggttcaaatcctacccccgcaaccaagcacaccagacgcatgtgcagcgcatatgaccgatgcgcgcttcgtcgacaagaacccggctccatgccgggtttttgttttctgcgcgcggcgccgttattgcgccgcccactcgaccgccgccttcgcatgcagcgcggtcgtatcgaacaccggcagcggcgagtcgtccgcgccgatcagcagcgtgatttccgtgcagccgaggatcaccgcctgggcgccgcgtgtcgccagttcctcgatgatcgtcacgtacgtcgcgcgcgattccggcgcgatgacgccgtggcacagctcgtcgtagatgatccggtgcacgtcgtcgcgcccgcgttcgtccggcacgagcacctccatgccgaacctgtcgcgcaaccgctccgcgtagaacggcaactccatcgtgtagcgcgtgcccagcagcgcgacgcgctcgatgcccgcatcgcgaagcgcggcgccggtcggatcggcgatgtgcaggaacggcagcgtcaccgcggcttcgatcgcggcgtggacgcgatgcatcgtattggtcgtcaacacgacaagatcggcgccggccgcttcgagctgccgcgcggcactcgccatccgctcgccgagcgcggcccagtcgtgcgtgcgctgcagcgcttcgatctccgcgaaatcgaccgtgaccagcacgcttttcgcgttgtgatgtccgccgtgcagcgccttcgaatggcgattgatcatccggtagtactcggccgacgattcccagctcatcccgccgatcagtccgatcgtcttcatccgtcacctttgcgtttcgtgtattgcggcagacgagtataggcgccgctgcccgcgccggccggtacgatccgtgcaaagcaggccggtacggcacagccgggcgcgaccgcacgcgacagttgaaactggcactgtgtttttgtacagtatcggcaccgtgaacccgaccatcattccgcctgccgatccgcacgcgccgccgccgggcgacgtgctgccgcgcatgcgcaagatcattcattgcgattgcgactgcttctacgcgtcggtcgagatgcgcgacgacccgtcgctgcgcaaccggccgctcgcggtcggcggccggcccgaccagcgcggcgtgatcgcgacctgcaactacgaggcgcggcgctacggcgtgcattcggcgatgtcgtcggcgctggcgatgcgcaagtgtccggacctgctgatcctgccgtccgcgatggacaagtaccgcgcggcatcgcggcagatcatggcgatctatcgcgactacacgcccgacgtcgagccgctgtcgctcgacgaggcgtacctcgacgtcagcgggtcgaagcggtgccagggcagtgcgacgctgattgcgcgggagatccgtcagcgcgtgcacgatacggtcggcgtgaccgtgtcggccggcgtcgcgccgaacaagttcatcgcgaagatcgcgtccgactggaacaagcccgacgggctgttcgtcgtgcggccgcacgagatcgacgcgttcgtcgcggcgctgccggtgcgcaagctgcacggcgtcggcaaggtgacggcctcgcggctcgaccggctcggcatccagacgtgcgcgcaattgcgcgactggcagctgatcgacctgcaccgcgaattcggcgcgttcgggcggcggctgtacgaattgtcgcgcgggatcgacgagcggccggtgcaggccgaccaggagcgcaagtcggtcagcgtcgagacgacctacgtcaccgatctgacgacgctcgagcagtgcgcggcagaaatccgccgcctcgtcgtgcagctcgacgcgcgtatcgcgcgggcgggcgccgcgcggtcgatccgcaagctgtacgtgaagatccgcttcgccgatttccagcggacgacggtcgagtgcgtggccgacgcgacgcatgcggatacggccgtcacgctgctcgcgaaggggctgcaacggcgtgcgcaggcggtgcggctgctcggcgtcggcgtgcgcatcgacgaggataccgccgagcgccacgggcagttctcgctgttcgacgacgaaaccggtaacgccgacgacgcagccggcgaaccccggcgccatgaaaaaggcaccgccgcggcggtgcctttcgatgcagccggacgagccggacagcgggcgctcagtgcgcgggggcagccatcccgttgtggcgcagcagcgcatcgatctgcggctcgcggccgcggaacgccttgaacgagtccatcgccgggcggctgccgccgacctcgaggatttcgcggcgatagcgcgtgccggtcgccgcgtcgagcacgctgccgctcgcggcggccgcttcctcgaacgccgcgtacgcatcggccgacagcacctcggcccacttgtagctgtagtagccggccgcgtagccgcccgcgaagatgtggctgaacgtgttcggccagcgcgagaacgcggcttgcgggatcacgtgatagcgttcgttgatctcgcgcgcgaatgcggtcacgccggtggcgccggccgggtcgaagtcgacgtgcagcagcatgtcgaacatcgagaacacgatctggcgcagcgtgccgagcccgctctggaagttcttcgcggcgatcatcttgtcgaacagctcgcgcggcagcgcggcgcccgtatcgacgtgcgacgacatcgacgacagcacgtcccattcccagcagaagttttccatgaactgcgacggcaactcgacggcatcccattcgacgccgttgatgcccgacacgccgagctcgtcgacgcgcgtgagcatgtggtgcagcccgtggccgaattcatggaacagcgtgatgacttcgtcgtgcgtgaagcatgcgggcttgccgccgaccggtgccgagaagttgcaggtcaggtacgcgaccggcgtctgcacggtgctgccgcgcttcgcgcgcgaacgcgcgtcgtccatccacgcaccgccgcgcttgccttcgcgcgcgtacaggtcgagatagaactgcgcgacgagcgagccgtcgcggttttcgacgcggaagaagcgcacgtccttgtgccacaccggcgcatcgtccggcttgatctggacgccgaacagcgtctcggtgacggtgaacaggcccttcagcgcggccggctccgggaagtactgcttgacctcgttttccgagaacgcgtagcgctgctggcgcagtttctcggacgcgtatgcgacgtcccacggcgcgagttcggcgaggccgagttccttcgcggcgaacgcgcgcagctcgtcccagtccttgtccgcgtgcgggcgcgcgcgcgtcgcgagatcctcgaggaacgcgatcacctgctgcggcgattcggccatcttcggcgcgagcgacacttcggcgaagttgcggtagccgagcatctgcgcctcttcgcggcgcagcttcagcgcatcggcgacgatcgccgtgttgtcccattcggccttgccgtcgccgtactgcggaccgagttccgacgcgcgcgtcgcataggcgcggtagagcgtctcgcgcagcgcgcggttgtcggcgtattgcagcaccgggaagtacgacgggaagtgcagcgtgaatttccagccttccttgccgtccttctgcgcggcttcgcgggcggcctcgatcgcgtcgccgggcaggccggccagttcggcgtcgtcctgcacgatgtacgcgtacgcgttggtcgcgtcgagcacgtgatcggagaaggccttcgacagcgcggcctgctgttcctgcagttccgcgaagcgcggcttctggtcctcgggcagctcggcgcccgacaggcggaaatcgcgcagcgcgttgtcgaggatcttttgcgttcggtggacagcgttgcgtattcggcactcgcggcgatcgccttgtacttctcgtacagcgcgaggttctggccgacgctcgaccagaattcggtcacgcgcggcaggttttcgccgtaggcggctcgcagttcgggcgtatcggcgaccgcgttcaggtggccgacgatgccccacgcacgaccgagcggctccgtcgcgtgctcgaccgtctcgacgacatccgcccaggttgccggcgtcgcggccgcgcttgcggtctcgaccgcgcggttggcggcatcgagcagcgtgtcgagcgcgggcgtcacgtgttccgggcggatctcgccgaagcggggcaggcccgagaagtcgagaagcgggttggtgttggcgctggcggacataagactcctgtctgttgccggatgaaccggagtgaaaagggtaaggcgcgcacggcagcgcggcgcccgatatcgacattattggggcgcatcgcgcgctttccaatcgttagtttctaacgacgcgattggcgcggggtcgaatgcgggacggggcggccggcaaggtgcggccggcgaggcgccggcgcgcggaaccgcacgccggctgaacgggcagggtcaggcggctgcgtcggccgcgcgctcggcggcttcgatcgtgttgatcagcagcatcgtgatggtcatcgggccgacgccgcccggcaccggcgtgatgtggccggccacttccttcacgcccgcgaagtcgacgtcgccgcacagcttgcccgcatcgtcgcggttcatgccgacgtcgatcaccgtcgcgccgggcttcaccatgtcggcggtcaggatgttgcgcttgccgaccgcggcgaccacgacatcggcctgccgcgtatgcgcggcgaggtcacgcgtcttgctgtggcagatcgtcacggtcgcgccggcgtcgagcagcatcatcgccatcggcttgccgacgatgttcgagcggccgatcacgaccgcgttcgcaccctgcagcgggatgccgtgcgcctcgaacatcttcatcacgccgtacggcgtgcacggccggaacagcggcttgccggtcatcagcgcgccggcgttcgcgatgtggaagccgtcgacgtccttctccggcgcgatcgcctcgatcaccttgtggctgtcgatgtgcgcgggcagcggcagctggacgaggatgccgtggatcttcgggtcgcggttcagctcgtcgatgcgcgcgagcaggtcggcttccgacagcgtggccgggtacgcatccttcagcgagaagaagccgttgtcctcgcacgccttgatcttgttgcgcacgtagacttcgctcgccgggttggcgccgacgaggatcaccgcgagaccgggctggtggccgcgtgcggtcagggcggcggcgcgttcggcggcctgcgcgcgcaaggtcttcgagagggcgttgccgtcgatgaggagggctgtcatggtggtggtcctgccgggaagttggaatgcgggcgtgcggcacgcgaagcgccgcagcaaagcacgcaattataccggtcgcctgccgtcgtccgacagtgaatacaaggaaagcgtcatggcgccggtgccggcgctccgggaggaagcgccgggatgccgcgcgagtgggccgcatcgcgcggcgcggtagtgtccgatgtgcggccggccgggcagggctgcccggagccgcgtgcgacgctcaggcctgcttcttcgacagcgcgaggcgcagcaggtccgccaccgtattgacgttgagcttttccatgatgttcgcgcggtgcgcttcgaccgtcttgatgctgatgccgagatcgtcggcgatctgcttgttcaggcggcccgcgatgatccgttcgagcacctgctgctcgcgcgcggtcagcttcgacaggcgttcgctcgcggcacgctgctcctggacgctcttgctttcgcttcgggccttgtcgagcatccgctcgacgagcttgcgcagctcggcttcgtcgaacggtttctcgataaagtccatcgcaccctttttcatcgtcgacacggccatcggcacgtcgccgtgacccgtgacgaagatgatcggcagcgcggcattgtcggcgatcaggcgctcctgcagctcgagaccgctcatgcccgacatccgcacgtcgaggatcaggcacgcgatctggccggcctgctgcgccggctggtacgcatcgaggaactgctcggcgctcgagaagcattgcacgcgatagccgttcgcctccagcagccagcgcagcgagtccgtacggcctcgtcgtcgtcgacgacgaagacggtttcctgagtggtggtgacagggctattcatagttctcccgtaacggtatgtgatgccgatgcctcgcgcccccttggccgagatcagcgggttcccaatgggcaggctgcagtggaacgtcgcgccggaaatgcggccatccggctcgacgttgttgaccacccacagacgcccccgatgcgattcgatgatcgaacggcagatgttcagccccatgcccatgccatcggacttggtgctgtaaaacggttcgaacaggcgctcggcggtcgcttcgtcgacgcccgggccctggtcgatcacgcggatgtcgacgaatcccgcctcgatgtcggcgatgacgcggatcacgccgtccgccgacgccggcttcacgtcggccatcgcctcggccgcgttcttcatcaggttcacgagcacctgctcgatcagcacggggtcgacataaataataggcattcttgcgaggatttccgtgacgatccggatcctgcgcttcctggcctcgatttcagcgagcccgaccgcgtcggcgacgatgtccgcgacccgggccggctggcgcttcggttcgctgcgcttcacgaattcgcggatccgcttgacgatcatcccggcgcgcagcgcctgctgcgcggtcttttccagcgcgggctgcagcgtctcgggcgtgccgcggccgctcttcacgagcgcgagcgttcccgagcagtagttgttgatcgcggcgagcggctgattcaattcgtgagcaatcgacgacgccatttcacccatcgtcatcaatcggctcgtgaactgcagcttctcttcctgctggtgcgcgagctcctgcgccttcttgcgggtcgtgatgtcggtcgcgatctgcatctgcgcgaggtggccgtccacccactggatgtactggcggcgcacctcgaaccacttctggatgctctcgacgtacacctcctgcgcatcggccgtgctgctcgtcagcgcggcggccggcaagcccgcgaacgcgtcgaccatgtcgatcgagtcggacgatgcctgcgcgcggtcgaagccgccgcccgacagctcgagatggccgtccgggcgaatgccgaacaggtggcggtagtagcggttcgcgaacagcagctcggcttcgtcggcggccagcaccgacaccgcggcgtcgaggctttcgagcaccgtcgtgaagcgctcgtgcgcggccgcgagttcctcgcgtgcacgcttcggctcggtgatgtcggtcatcgacgacatccagccggtctgtcggcccgaactatcgatcagcggcgacacgtacaggcgcgcatggaacagcgtgccgttcttgcgccgcacgcgcagctcgaagcccgagctcggcgccttgccgcgcagcgtcatgtcgagctggcgctgcatttccgggtaagcgtcgcgcggccagtacgggaacggcgcgaccttgccgacgaggtcggtttcgtcccagcccgtcatccggcagaacgcggggttcacgtgcgtgatgcggccgtgcatgtcgagcacgcgcatgccgatcagcaccgaattctccatcgcgcggcggaagaacgcttccgcgtacagcgcctgctgcgcctcgaagcgctggcgcgtgtgcttccacaggctccagaggctccacagcacgaagcacgacaggcccgccacgagccacacgagcgtgttgttggtgaggttcgtgagctgcgggaatgcgtacacgcgcacggtcagcccctggccgggcggatcgagcggcaggtcgtagtgcgagtcgcgcggcaggcgcgggcgcgtcgacgtggacgacagctcgcggttgttcgcgtcggtgatcgagatcttgtacttcgacgacagttcctgcgggatgtcgtgcttcaggatgccttcgaccgagaacaccgcggcgatcgagccgaggtactcgcggtcgccgcgcatgacgggcgtctgcagcgtgatgaagccgttgccgaagtcgtcgtagatcagcggcgaataggcctggcggcgcgtgctgcgcgcctcgtcgtatgcgccgcgcacggcgtcctgcatctgcgcttcgccgggcttcgcgagccgctggccgagcagcggcggatgcacggtcggccagcgctgtacgccgggcgacgtgtaccagttcaggtagaggatttccgggtgcgtctgcatcacgtccgcgacggccatctggaacgcgttctggtcgaggcggccggatgcgaggtcgcgcgacagtgcctggagctgttcctgcgcgcccgtcatcgacaggcggatctgctgctgcgcccacgcgacgttccggaagagggtgtcttcctgctgctgctgttcgcggcggttgaggctccacaggatgaggctcatcaccaccaggaacacgaggatcgacagcagtggcgtcagcaaataggaattggaccaccacggtccgtggtgccaacgggacggctgcgactccgccggcgggcccgacggtcgcgccgagcgtgcgaaaagccgatcggtcaacatggcaggattgtagcgcagcgcaatacatggaaaacctataccggatatgttgaacggaaacggatttgtttcgccgggacgcgccggagagccccgaaatatgggtgcagcgcagcaatatttcgtattgcgagaaaagatctcactattcgaaaattttgttgcgcaggcccgcgcacgctcattacaatccgctggagcttgcccgcagccggtcgcgtcgcgtcgtctgcacgagagcgatcctcacattccaggacccaggagacgagaatgtccgctgtaccgaacgaagtgatgaaatatgtcgccgccgaacgtgacgacgacccgcaagaaaccgtcgagtggctggagtcgctcgatggcgtgatctcctccgtgggcaccggccgcgcgcattacctgatcgaaaagcagatcgagttcgcccgcatgcacggcgaacacctgccgttctccgccaataccccgtacatcaacacgatcccggtcgaagcccaggcgaagatccctggcgaccaggacatcgagcaccgcatccgttcgtacacgcgctggaacgcgctggcgatggtgctgcgtgcaggcaaggacacgaacgtcggcggccacatcgcgtcgttcgcgtcggcagcgacgctctatgacgtcggctacaaccatttctggcacgcagcgtccgagcagcacggcggcgatctcgtgttcgtgcagggccactcgtcgccgggcgtgtactcgcgcgcattcctgctcggccgcctgaaggaagagcagctcgacaacttccgccaggaagtcgacggcaacggcatttcgtcgtacccgcacccgtggctgatgccggacttctggcagttcccgaccgtgtcgatgggcctcggcccgatcatggcgatctaccaggcacgtttcatgaagtatctggaagcgcgcggcatcgcgaagacggaaggccgcaaggtgtgggcattcctcggcgacggcgagacggacgagccggaatcgctcggcgcgatcgggatggcgagccgcgaaaagctcgacaacctcgtgttcgtgatcaactgcaacctgcagcgtctcgacggcccggtgcgcggcaacggcaagatcatccaggaactggaatcggaattccgcggtgccggctggaacgtgatcaaggtcatctggggcagccgctgggatgcgctgttcgcacgcgacaagacgggcgcgctgatgcgccgcatgatggaagtcgtcgacggcgagtaccagacgtacaagtcggagtcgggcgcgttcgtgcgcgagcacttcttcaacacgcctgaactgaaggcgctcgtcgccgactggtccgacgacgacatctgggcgctgaaccgcggcggccacgatccgcacaagatctacgcggctttccacgaagccacgaacacgaagggtgcgccgaccgtcattctcgcgaagaccatcaagggctacgggatgggcgagtcgggccaggcgatgaacatcacgcaccagcagaagaagctgccggtcgagcaactgaagaagttccgtgaccagttccgcctgccgatcaccgacgagcagatcgccgacgtgccgtacctgaagttcgaggaaggctcgaaggaactcgaatacatgcgcaagcagcgcatggatctcggcggctacctgccgcatcgccgcgagaaggcgacgtcgctgccggtgccggcgctcgacgcgttcgaaccgctgctgaagggcacgggcgagggccgcgagatctcgacgacgatggcgttcgtgcggatcctgaacatcctgctgaaggacaaggcgctcggcaagcgcgtcgtgccgatcgtcccggacgaatcgcgtacgttcggcatggaaggcctgttccgccagatcggtatctggaaccagcagggccagaagtacgtgccggaagattccgaccagctgatgttctacaaggaatcggagaccggccagatcctgcaggaaggcatcaacgaagcgggcggcatgtgcgactggatcgcggcggcgacgtcgtattcgacgcacggcgagatcatggtgccgttctacatcttctattcgatgttcggcttccagcggatcggcgacctggcatgggccgcgggcgacatgcgttcgcgcggcttcctgctcggcggtaccgcgggccgcacgacgctgaacggcgaaggcctgcagcacgaagacggtcactcgctcctgtgggcggcatcggtgccgaactgcgtgagctacgacccgaccttcggctacgagctcgcggtgatcgtccaggacggcctgcgccgcatggtgcaggaccaggaggacgtgtattactacatcacggtgatgaacgagaactacgagcacccggcgattccgcagggcgagcacgtggcggccgacatcatcaagggcatgtactcgttcaagaaggccgacgccgacaagaaggcgccgcgcgttcaactgctcggcgcgggcacgatcttcaacgaagtgatcgctgccgccgacctgcttaagaacgactggggcgtcgccgccgacctgtggagcgtgccgagcttcaccgagctggcgcgtgaaggccaccaggtcgagcgctggaacctgctccatccgaccgaggagcgtcgcctgtcgcacgtgcagaagtgcctgaaggacacgcagggcccggtcatcgcgtcgaccgactacgtccgcgcgctggtcgaccagatccgcggccagatcgatcgccgcttcgtcgtgctgggcaccgacggtttcggccgctcggatacccgcgagaagctgcgtcacttcttcgaagtcgaccgtcactgggtcaccgtcgccgcgctcaacgcgctggccgacgagggcacgatcgagcgcaaggtggtcgcggacgcgatcgccaagtacaacctcgatccgtcgaagcccaacccgatgaccgtttaacgcacacgccgtgtgatgccgcgcgccgcttccgcgagaagcgcgcgcggccatggagacagaaacagatgagtcaagcgatcgaagtgaaggtgccggatatcggcgattacaaggacgtgccggtgatcgagatcggcgtgaaggtcggcgacacggtcgagccggagcagtcgctcgtcacgctcgagtcggacaaggcgacgatggacgtgccgagcccggtaggcggcgtcgtgaaggaaatcaaggtcaaggtgggcgattccgtgtcggaaggctcgctgatcatcctgctcgaaggcggcgccgcggcgcaggccaacggcgcggccgcgccggccgcagcaccggctccggcggcagcgcctgcgccggccgcagcggcaccggctgccgcaccggcagccgccggcggcacgctcgaagtgaaggtaccggacatcggcgactacaaggacgtgccggtgatcgagatcggcgtgaaggtcggcgacacggtcgagaaggaacagtcgctcgtcacgctcgagtcggacaaggcgacgatggacgtaccgagcccggcagcgggcgtcgtgaaggaaatcaaggtcaaggtgggcgattcggtgtcggaaggcacgctgatcgtgctgctcgaagccgcaggtgcagcggctgccgcaccgcaggcgagcgcaccggcgcccgccgcagcagcgccggcgccggcacccgccgccgcacccgcgaaggccgcaccggccgctgccgcaccggctccggccgcggcaccgtcgggcgaataccgcgccagccacgcatcgccgtcggtacgcaagttcgcgcgcgaactcggcgtcgaagtcgcgcgcgtgcagggctcgggtccgaagggccgcatcacgaaggaagacgtcacgggcttcgtgaagggcgtgatgaccggccagcgcgcggcaccgggcgcggcagccgcgccggcaggcggcggcgagctgaacctgctgccgtggccgaaggtcgacttctcgaagttcggcccgttcgaagcgaagccgctgtcgcgcatcaagaagatctcgggcgcgaacctgcatcgcaactgggtgatgatcccgcacgtcacgaacaacgacgaagcggacatcaccgagctcgaagcgctgcgcgtgcagctgaacaaggagcacgaaaaggcgggcgtgaagttcacgatgctcgcgttcgtgatcaaggcggtcgttgccgcgctgaagaaattcccgaccttcaacgcgagcctcgacggcgacaacctggtgttcaagcagtactaccacatcggttttgccgcggacacgccgaacggcctcgtcgtgccggtgatccgcgatgcggacaagaaggggctcgtcgatatcgcgaaggaaatggccgagctgtcgaaggccgcacgcgacggcaagctgaagccggaccagatgcagggcggttgcttctcgatctcgtcgctcggcgggatcggcggcaccaacttcacgccgatcatcaatgcgccggaagtcgcgatcctcgggttgtcgcgcggccagatgaagccggtgtgggacggcaagcagttcgtgccgcgtctgacgctgccgctgtcgctgtcgtatgaccatcgcgtgatcgatggcgcggaagctgcgcggttcaatgcgtatctcggcgcgttgctcgcggatttccgtcgcatcattctttgatgagcggggagtgtgctcgcgggggcgtgggttttatgtcggtcatccacgtttcggcgttgaacctgtcttgctaacggtctgctagcgtcgcccctgcgcggtggcggtcacttttctttgtcttccaaagaaaagtaaccaaagaggcgcgtccttgggcggacggcaaaggtggtcctgcccaacgtcgcgttctcttgtcaggccgtagtcgcagtagtgggttcttccgcgggtttctcctctctgtctgcagctaatcaagaaggggacagtaatgagtctcatcgaagtcaaggttccggatatcggcgatttcagcggcgtcgatgtcatcgaagtcaacgtgaagccgggcgacgtgatcgaaaagagcaaacgctcatcacgctcgaatcggacaaagcctccatggaagtgcccagcgacgtcgccggcaccgtcaaggaagtcaaggtcaaggccggcgagaaagtctcgcaaggcaccgtcatcgccatcgtcgaagcagcggcaggcgccgccgctcccgcgaaagcacccgaagcagcaaagcccgcggcagctgcgccggcaccggccgcagccgctccggcacccgcgccgcaagccggcagctacgcaggcgccgtcgacatcgagtgcgacatgctcgtgctcggcgccggccccggcggctactcggccgcgttccgcgcagccgacctcggcatgaagaccgtgctcgtcgaacgctactcgacgctcggcggcgtgtgcctgaacgtcggctgcatcccgtcgaaggcgctgctgcatacgtcgctcgtcgtcgaggaagccgcggcgctcgcgtcgcacggcatcacgttcggcaagccggaagtcgatctcgacaagctgcgcgacttcaagggcggcgtcgtcaagaaactgacgacgggcctcgccggcatggccaaggcgcgcaaggtcgaagtggtcacgggcgtcggcgcattcgtcgatccgttccacatggaagtgcagggcgaaaacggcaagaaggtcgtcaggttcaagcaggcgatcatcgcggcgggctcgcaggccgtgaagctgccgttcatgccggaagacccgcgcgtcgtcgattcgaccggtgcactcgaactgcgccagctgccgaagcgcatgctcgtgatcggcggcggcatcatcggcctcgaaatggcgacggtgtactcgacgctcggcgccgagatcgacgtcgtcgaaatgatggacggcctgatgatgggcgcggaccgcgatctcgtgaaggtctgggaaaagtacaacgcgaagcgcttcggcaacgtgatgctgaagaccaagacggtcggcgcggaagcgaaggaagacggcatctacgtgaagttcgagggcgagaaggcgccggcggaagcgcagcgctacgacctcgtgctcgtcgcggtgggccgcagcccgaacggcaagaagatcggcgccgacaaggcaggcgtcgccgtcacggaccgcggcttcatcgacgtcgacaagcagatgcgcacgaacgtcccgcacatcttcgcgatcggcgacatcgtcggccagccgatgctcgcgcacaaggccgtgcacgaaggccacgtcgcagcggaagccgcgcacggcgagaaggcgtacttcgacgcactgcagatcccgtcggtggcttacaccgatccggaagtggcgtgggccggcaagacggaagaccagtgcaaggccgaaggcatcaagtacggcaaggccgtgttcccgtgggccgcatcgggccgcgcgatcgcgaacggccgcgacgaaggcttcacgaagctgatcttcgacgaggaaacccaccgggtgatcggcggcgcgatcgtcggcctgaacgcaggcgacctgatcagcgaagtgtgcctcgccgtcgagatgggcgcggacgcggaagacatcggcaagacgatccatccgcacccgacgctcggcgaatcggtcggcatggccgccgaactgtacgaaggcgtctgtacggacctgccgccgcagcgcaagaagtaacgcgaccggggccggcatgttgccggccacaaaaacgccgcctcccgggcgatccgggcggcggcgttttctttgcgggaggccgatgctcaaacgaccgttcgagcacggccggcggcttggcgattccggcgtggtgcggcgccagaaacgaaaaagccgcgctgtgcgcggctctttcaggagcaggggacgcttacgcggccggcttgctcgaacgacgtgcggcagcggcggtagcagccttcgttgcgacggcagcagcagcgttgaagttcgtttcagcgatttcgacggcttgcttcgtggccttctgaaccgtttcgtacgtggtgttcgcagcgttcagtgccgacttcagtgcggcgacagccgtttccgaaccggccggggcgttcttcgcgacgttgtcgacgagtgcctggaccttcttgttctgttcttcgaattgcgcttctgcaaccttcgcgaactcggcttgcgtcgacgatgcgatttcgtacaggtgacggccgtacgacagcaccttttccgcgaccggctgcgacaggctggcttgcagggcgatcagttcctgtgcgtccttcaccgacagcaggcgctgtgcgttttcctggccttcggccagcgtcgacttcacgacctgcaggttgagttcgatcagcttctcgacgccttcgaacgccttggtcgtcagaccgaacaggctttcgaggttggctttctgtgcagcggcgatttgctcggggtcagcaaggacatgtccagctcctgaaaagcgatcgcgtcgatcgcagggtaaagggcactacgacggggaacctcggatgcgcgtgctttgtgcaacgcagcaatgaggcctattttagggcagagaaaacggatgtcaagtgtttttgtgcgttgcacaatcgcgacaaattatcgataaaacaacaagttatcgtgcccgttcggaatcggtttcacgcgcgtctcccagatggtgcgcacggacgcgggcgcacgcggcgcaccatgatcatgcacaggtaaacctgacagggtcatggaacgttatccttctgttcctgtcgaaaacgcgccgtttcgatgcgcgtaccgtggcgacgtgccgccgccacggccgagaccggctcccaggcaccccgagcgccggatacgtagtttcccgctttaaatcgcctccgaagtgacgttatctcaattaaccgtgtgtaatcgggagacgggtactgtcgggcagcgcatcccatgaatttttcgatgggagcgggagggttcattggtcagaggttggccaacccttacattccggtttaacgacgatcggtaagtgcctaatattgctcttttttcagctttaactacacttgcggaaacctcccgcccgctttgtccagaccccaatgaaagccgaatcgttttcaccgcgcagattgttgcagagcatgacgctcggcacggctgtgtcggtcgctgtcgccttgctggcgaccactgcgtccgtcacgcccgctgacgcctttgccgccactgcgaagacccaacaagccgccaagaaaaaggctgtcgctcctgcttcgtccgcgaagaagaagtcggccaaggccacctccgacaaatcagccaaggtcgccgcagccgatgcgccgcgcgcaaaggcgtcgcgcaagcgcgtgacgctcgcggcgaacagcgtgcgtgccggccatcacggcgcggttcgcaaggtcgcgttccagccgcgtcggcagagcgtcggccaggcgttcggcctgcacgacacgccggacgcgctcgcgctgcgttcgagcgtcgcgtacgtcgtcgaccagaattccggcgagccgctgttcgacaagaattcgcacgccgtcgtgccgatcgcgtcgatctcgaagctgatgacggcgatggtcgtgctcgactcgaaggcgccgatggccgaccagatcgaagtcaccgacgaagaccgcgactacgagaagggcacgggctcgcgcctgtcggtcggctcggtgctgtcgcgtgaagacatgctgcacatcgcgctgatggcgtcggaaaaccgcgcggccgccgcgctgtcgcgttattacccgggcggtcgtccggcgttcatcgccgcgatgaacgcgaaggcgaagtcgctcggcatggccgatacccatttcgagaattcgaccggcctgtcgagctcgaacgtgtcgagcgcgcgcgatctggtgaagatggtcaatgcggcgtaccagtacccgatgatccgtcagttctcgaccgatcgcagctacgaggtgtacacgggcaagcgcaatctcgcctacaacagcacgaacgcgctgatccgcggcaacggctcgtgggacatcggtctgcagaagacgggcttcatcaacgaagcgggcgaatgcctcgtaatgcaggcgacgatccacggccggccgatggtgatggtgctgctcgattcgttcggcaagtattcgcgcttcgccgacgcggcgcgcctgcgcaactggctcgacgccggcggcggcgagcgcctgacggcggccaacacgccgaacggtgggacctgatcgcacggcggcgtggcggttcgccgccgcgtcgatggtcgaaaaagccccgcaatcgcggggctttttactgcgggcgcgcgggagcggcttacgcctgccgctgcagcccgtccgcatccttcgtgggcgccggccggtagccgagcgattccgaaatggtgagggcagtacggctcaactggccgagccaggcatcctggaggcgatcggccggcgccgacagcgacaggcccgcgacgagcttgcccgaatcgtcgtagatgccggccgcgatacagcgcacgccgagctccagttcctcgttgtcgcgtgcgcacgattgctggcggacgatcgtcagctcgcgctcgagcttcgcgatgtcggtgatgctgttctgcgtatggccggacagccccgtgcgcgttgcataggcacgcacgcgcgacgtttcgtcggctgcaaggaacagcttgccgaccgacgtgaggtgcagcggcgcgcggccgccgatcgcacggacgacctgcatccccgagcgctccgaatacgcgcgctcgatgtagacgatctcgtcgccctggcgcaccgacaggttcacggtctgcccggtgagacggtgcagctcgcgcatcggcatcagcgccgcgtcgcgtaccgacaggcgtgccttcacgaggttgccgagctccagcagccgcatgccgaggcgatacgtgccgggatcggagcggtcgacgaggcggcaggtcaccatgtcgttgaggatgcggtgcgccgtagacgggtgcagctccgtgcgctgcgcaagttccttcaggctcacggggtcactgtgcgcggcgagcgcgtccagcaaccgcatcatgcgttcgatcacctggatcgacgttttggaatccggggtgggttggctcatgtcggggagaaatcggttgacgcggcaagcggtgttgcaacgattgtatctcgtatcgtgaaaaagcgaacgccgttcgaggaagtcctcgtttcgcgcagtgcgggcttgcgcgcgagccggcgttggtctcgccggccaaacggcggataatgagagccgttttctcgaaggagcgcgtatgcgagtcggtttgttcgtgacctgcctggtcgatctgatgcgtccggaaatcggtttttcggcgctcaagctgattcgcgacgccggctacgaggtgatcgtgccgcccgcgcagacttgctgcggccagccggcctacaactcgggcgaccgcgcgctcgcccgcgatctcgcggaaaagacgctgcgcgagttcgagcagttcgattacgtcgtcgcgccgtcgggttcatgtggcgggatgatccgcgcgcactacggcgacctgttccgcgacgaccccgagctgatgggcgctacacgcggttccagcagaaggtctacgaactgaccgatttcctggcgaatgtcgcgaaggtctcgctcgcgccgggtgaattcacggggcccgtcacctatcacgattcgtgctcgggcctgcgcgagctcggcgtgaaggcacaaccgcgcgctgctcgcgcagcgcggcattgcggtcaccgagatgaaggactgcgagcactgctgcggcttcggcggcacgtttgcggtgaagtacggcgacatctcggcggccatcgcggacgagaagtgcgcgaacgtgcgtgcgtcgggcgcgggcgccgtcgtgctcggcgatctcggttgcatgctgaacatcgaagggcggttgcgccgcaccggcgaccgcgacacgcgcgtgctgcacgtcgcgcaggtgctggcgggcgacgtctgacgcccggttccgctcacttttccccgataccgcgatgcaagtccaatcgatgcatttcaaggcgcgcgccggccagaagctggccgaccagcgcctgcagcagaacctgaagaagctgtcgacgaagttcgtgtccgcgcgtgccgacgcgatgaccgcgatcgacttcccggccacgcgggcggcgctgaaggcgcgccgcaaccgcgcgctggagaacctcgacgtgtggctcgaggccttcgagcaggaggcgacgcggcgcggcacgaccgtgctgttcgccgagacgacggcggacgccgcgcggctcgtggccgacattgcgcgccgttacgacgtgaagaaggtcatcaagaccaagtcgatggtgtcggaggaaatgcgcctgaacgcggtgctcgcggaaatgggcgtgcaatcgatcgagacggacctcggcgaatacatcctgcagatcaacgacaacgagccgccgagccacatcatcgcgcccgtcgtccacaaggacaaggacgagatcgccgacctgttcgcgcgcacgcaccaccgcgagcggctcaccgagattccggacatgacgcgcgaggcgcgcgaggtgctgcgcccgcatttcatgtcggccgacatgggcgtgaccggcggcaacttcgtgatcgccgagaccggttcggtcgcgatcgtgacgaatgaagggaacgagggatgtgcacggtgatgccgcgcgtgcatgtggcggtgacgggcatcgagaaggtgctgccgaccctcgaggatcttgcgaccgcgatgcgcctgctgccgcgttccgcgacggggcagaagacgtcgaactatttctcgctgctgaccgggccgcgagggccgggtgacgaggacggccccgagcacaactacgtggtgctcgtcgacggcggccgcacggggctgatcggcggcgagttccaggagatgctgcgttgcatccgctgcggcgcatgcatgaaccattgcccggtttaccagaaggtcggcggccatgcgtacggctgggtctacccggggccgatgggttccgtgctgacgccgagttacgtcgggctcgatcgcgcgctggatctgccgcaggccgcgacgctttgcggagaatgcgacagcgtctgcccggccgggattccgctgtcgcacctgttgcgcacgctgcgcgagaagcaggtcgagcggcacctgcggccgtggcgcgagcgggcggcgctcaccgcatggggtttcgtcgcgcggcggccgatgctgtacgcactgacgacgaagctcgcagtgcgcatcctcgagcggctgggtgctggcggcacgctgcggcgcctgccgatgatgggtggctggatggacacgcgcgacatgccgaccccgaccgggcgcacgttccgcgaactgtacgcggcgtcgcaaagccacctcggctgacgactgttcatccggtgacaacagagcgttcgctatttggatatttatctcgatagatgcggtctatagaatctcgtctgtagtccccggaatcgggtttcggggtacgaggtcaaggaggtcgcatcatgaaaaagacaatatcgatgtactggccgctggcaatcgtcgttccgctggccgcggctgcctatctgcatgcgatggccgatgcgccgtcgcgtggcccgctcgcagttcaccaggcatccgccgaactggcgcgtgcggtgtcgttcgggctggtcgacgacgcggcgaagccgttgccggcggcatccggcgacgtcgtgctcgtcgcgccgaaggcgctgtaatgcacggcgccgtcgctttgccgggcggcgcgattccggtcgcctttgtataatggcgtgttcttctcccgcgcggttcgccgcggctttccgatagtgcgatgacccgcgtttcgatctgtttcgtctgtctcggcaacatctgccgttcgcccaccgcggaaggcgtgatgcgtcatcaggtcgatgcggccgcgctggcggaccggatcgcgatcgattcggccggcaccggcgactggcatgtcggcgagccgcccgatacgcgtgcgcaggcggccgctcgcggccgcggctacgacctgtcggcgctgcgcgcacgacaggtgagcgcggcggatttcgagcgcttcgacctgctgctcgcgatggacgaggcgaatctcgcggagctgcgccgccgctgtccgccgcagcatgtcgacaaggtgcgcctgctgatggaattcgcgccggattcgactgaaaccgaagtggccgatccgtatttcggcggggcgcagggcttcgagcaggtgctcgaccaggtcgagcgcgcgtgcgcgggcctgctcgagacgctccggccccgcacggagcgctgatcgcgcggtattcagcggtctacgaataccctttcaaagacatggatacttgactaaaaacgtcaaatatttatacttgaccaaaatcgtcaagattgcagtccctagacaccatgagactcaccaccaaaggccgtttcgccgtcacggcgatgattgacttggcactgcgccaggagcagggcccggtgacgcttgcaggcatcagccagcgccagcggatttcgctctcgtatctcgaacagctgttcgggaagctgcgcaggcatgaaatcgtcgaatccgtgcgcggcccgggcggcggctacaacctcgcgcgtcgcgcgcaggacgtcaccgttgccgacatcatcatcgcggtcgatgaaccgctcgacgccacgcagtgcggcggtaaaggcacgtgcgacggctcgaagcagcccgacggccattgcatgacgcacgagctgtggtcgacgctgaaccagaagatggtcgaatacctcgactccgtgtcgctgcaggatctcgtcgatcagcagcgcgcacgcgagggcgccctgcggtgttgcgcgatcgccgcacgccggagcccgtcgccgcgccggcagagccggtgcgcacgatgccgctcggccccaattcggtgttcaacatcgcgagttcgtgagcgcgaaggcgcccgccataccccataacgcacatagtccctgcacagaattcccggagcgacagatgacccaagagactctccacctgcccatctacatggattacagcgcgacgacaccggtcgacccgcgtgtggtcgacaagatggtgccgtacctgcgcgagcagttcggcaacccggcatcgcgcagccacgcgtacggctgggatgccgagcgtgcggtcgaggaagcgcgcgaacaggtggccgcgctcgtgaacgcggatccgcgcgagatcatctggacgtccggcgcgacggagtcggacaacctcgcgatcaagggtgccgcgaacttctacaagggcaagggcaagcacatcgtcacggtgaagaccgagcacaaggccgtgctcgacacgtgccgcgagctcgagcgcgacggcttcgaagtcacctacctcgacgtcaaggatgacggcctgatcgacctcgacgtgttcaaggccgcgctgcgtccggacacgatcctcgtgtcggtgatgcacgtgaacaacgagatcggcgtaatccaggacatcgagacgatcggtgaaatctgccgcgagaagggcatcgtgttccacgtcgacgccgcacagtcgaccggcaaggtcgggatcgatctcgcgaagctgaaggtcgacctgatgtcgttctcggcacacaagacgtacggcccgaagggcatcggcgcgctgtacgtgcgccgcaagccgcgtgtgcgcatcgaagcgcagatgcacggcggcggccacgagcgcgggatgcgttcgggcacgctgccgacgcaccagatcgtcggcatgggcgaagcgttccgcatcgcacgtgaagaaatggcgacggaaaacgagcgcgtccgcatgctgcgggacaagctgctgcgcggcctgtcgcagatcgaggaaacgtacgtgaacggcgacatggaacgccgtgtcccgcacaacctcaacatcagtttcaacttcgtcgaaggcgagtcgctgatcatggcgatcaaggacgtcgcggtgtcgtcgggctccgcgtgcacgtcggcgtcgctggagccgtcgtacgtgctgcgtgcgctcggccgcaacgacgagctggcgcacagctcgatccgcttcacggtcggccgcttcacgacggagcaggaagtcgacttcgtgatcaacctgctgaacagcaagatcgcgaagctgcgcgaactgtcgccgctctgggaaatgcaccaggaaggcatcgatctgtcgacgatcgaatgggccgcacactgagcgccggattgaacatacccgcgggcggattcgcgcacgcagacgtaacgagtcaaggagtctgagtcatgtcttacagcaacaaggttctggatcactacgaaaacccgcgcaacgtcggttcgttcgcgaaggacgacgacacggtcggcacgggcatggtcggcgcgccggcctgcggcgacgtgatgaagctgcagatccgcgtcggcgcggacggcgtgatcgaagacgcgaagttcaagacgtacggttgcggttcggcgatcgcgtcgagttcgctcgtcaccgagtgggtgaagggcaagacgctcgacgaagcactgtcgatcaagaacacgcagatcgccgaagaactcgcgctgccgccggtgaagattcactgctcgatcctcgcggaagacgcgatcaaggcagccgtggccgactacaagaagcgccacgacaccaaggaaggcgatcaggcagcagcctgagcggcatcgagcggctagagaaggaaacgcggcaggccccggtggcgcgccgcggcaaggacatcatggcaattacactgaccgaaaaagcagcacagcacgtccagaaatacctcgtccgtcgcggcaagggtatgggcctgcggcttggcgttcgcacgaccgggtgctcggggctcgcgtacaagctcgagtatgtcgacgagctggctcccgaggatcaggtgttcgagagccatggcgtgaaggtgatcgtcgatccgaagagtcttgcgtacatcgacggcaccgagctcgacttcgcccgcgaaggcctgaacgaagggttcaagttcaacaacccgaacgtgaaggacgagtgcggttgcggcgaatcgttccgcgtgtgacgcggatctccgcgcgatgcgggcaagaggcggcacgggccgcctttttaatgtgcggcgtttgccgtgcgacgaaccggaattgaacgcgacgatggtttcgctgaaagacagccacttcgacctgtttcacctgccggcgcaattcgcgctcgatgagacggcgctcgacgccgcttatcggacggtgcagacgcaggtgcatccgaccgcttcgcggcggccggcgatgcgcagaaacgtatcgcgatgcaatgggcaacccgtgcgaacgaggcgtaccgcacgctgcgcgatccgctgaagcgcgcgtcgtatctgctgtccctgcgtggtgtcgacatcggtgcggaaaacaacaccgcgatggagcccgcgttcctgatgcagcagatggagtggcgcgagggcatcgaggatgccgcggccgcccgcaatgtcgacgcgctcgacgcgctgctcgccgagttgcgcgaagagcggcgcattcgtgtggagcgtctcggcacgctgctcgacagcggcgccgatcaggcggccgccgaggccgtgcgccagctgatgttcatcgaacgggtcgcgtcggaagtgggcgcgcagatcgagcgcctcgaaacttaaccgcgtgcctcgcggcacgcgcagcaaacgggccgagcgcccgaacgaaccaagatggctttactgcaaatttccgaaccgggcatggcgccggcgccgcatcagcggcgactcgccgtcgggatcgatctcggcacgacgaactcgctcgtcgcggccgtgcgtaacagcgtgccggaggtgctgccggacgaagcgggccgtgtgctgctgccgtcggtggtccgctatctcgagaagggcggccggcgtatcggccacgaagcgaaggagcaggccgcgaccgatccgcgcaacacgatcgtgtcggtcaagcgcttcatgggccgcggcaaggccgaggtcgaaggcgcggcgaacgcgccgtacgaattcgtcgatgcgccgggaatggtgcagatccgcaccgtcgacggcgtgaagagccccgtcgaagtgtcggccgagattctcgcgacgctgcgctatcgcgcggaagattcgcttggcgacgacctcgtcggcgcggtgatcacggtgcccgcgtatttcgacgaagcgcaacgtcaggcgaccaaggacgccgcgcgcctcgcgggcctcaacgtgctgcgcctgctgaacgaaccgaccgccgcggcgattgcctatggcctcgacaacggggccgaaggcctctacgcggtgtacgacctcggcggcggcacgttcgacctgtcgatcctgaagctgacgaaaggcgtgttcgaagtgctggccgcgggcggcgattccgcgcttggcggcgacgatttcgaccatgcgctgttcggtcacgtgctcgcgcaggccggcatcgatgcgaagacgcttgcgcccgaggacgtgcgcctgctgctcgaccgtgtgcgcgtgctgaaggaagcgctgtcgtccgcgccgcaggcgtcgctcgacgtcacgctgtcgggcggtgcgcatctcgttcagacgatctcgcacgatacgttcgcgtcgctcgtcgagccgctcgtgcagcgtacgctcacgccgacccgcaaggcgctgcgcgacgcgcaggtcacgccggccgacatcaagggcgtcgtgctcgtcggcggcgcgacgcgcatgccggtgattcgcgacgcggtcgcgaagtatttcggccagccgccgctcgtgaacctcgatccggaccaggtcgtcgcgctcggcgcggcgatccaggccgacctgctcgcaggcaatcgcggcaccggtgacgactggctgctgctcgacgtgattccgctgtcgctcggtgtcgagacgatgggcggcctcgtcgagaagatcatcccgcgcaactcgacgattccgatcgcgcgcgcacaggaattcacgaccttcaaggacggccagaccgcgatggcgatccacgtcgtgcagggcgagcgtgagctcgtcgccgactgccgctcgctcgcgcgcttcgagctgcgcggcattccgccgatgacggccggtgcggcgcgcattcgcgtgacctaccaggtcgatgcggacgggctgctgtcggtgttcgcacgcgagcagcattcgggcgtcgaggcgtcggtcgtcgtgaagccgtcgtacggtctcgccgacgacgacatcgcgaagatgctcgaggacagtttcaagactgccgaaatcgacatgcgcgcccgcgcgctgcgcgaagcgcaggtcgaggccgagcggatgctcgaggcgacgcaggccgcgctggcggccgacggtgaactgctcgacacggacgagcgcacgcaggtcgatgcgttggccgcggcgctgcgcacgatcgcgcagggcgacgacacggacgcgatcgaaaccgcgaccaaggcgctggccgacggcaccgacgaattcgcggcgcgccggatggacaagagcatcaagcgcgcgttgtcgggccgccggctcgacgagatctgaactcacgaactgcgcatcggccggtaacggcccgcgcgatattgaaccgtgcggcgtctggcgccgcaccctgactgacggaacggacatgcctcaactggtggtgctgcctcacgtcgaactgtgcccggacggcgcggtgatcgacgcgacgcccggcaagagtatctgcgacaacctgctcgaacacgggatcgagatcgagcatgcatgcgagaagtcgtgcgcgtgcacgacgtgccacgtggtgatccgcgaaggcttcaacgatctgacaccgtccgaggaggacgaggacgatctgctggacaaggcgtggggcctcgagccgacgtcgcgcttgtcgtgtcaggcgatcgtgaaggaagattcggacctggtggtcgagattccgaagtactcgatcaaccacgcgaaggaaaatcactgacaggaaccggaggcaggcgatgaaatggaccgattcgcgtgaaatagccattgcgctggcggacaagcaccccgacatcgacccgcagcggatcaacttcgtcgacctgcgtcagtgggtgctcgaactcgacggtttcgacgacgatcccaagcactcgggcgagaagatcctcgaagcgatccaggcccactggatcgacgaatcggacttcgacgacgaagactgaacaccgcgtgcgccgtaacggcgcagacggccggtcatgaaaaacggctcgtgagcaatcgctcacgagccgttttcgttttcaggccgcttgccccgcgcacgacacgcgggcagggggcaccgatgcgatcaggcgattacgcgccgaccagcgtgccgttctcgatccgcacgcgctggccctggccgaaaggcggcgggttgtggtacgtgaacgtgcgcgtcgcgccgctctccatctgcacttgcacctgatagtcggtttccgcacgcacctgcttttcaacctggttgccggcgagaccgccgcccagcgcgccgatgatcgtcatcgcggtgcggccgttaccgtggccgaactggttgccgagcaggccgccggttgcagcgccgcccacggcgccgatccccgagctctggcccggcgtgcgcgtttgcgtgatcgcgacgaccgtgccgcagctctggcagtaggtctgggccggcgccgacggctgctgcgcgtattgcggcggctgcggtgccgtcgtatggcggcggtgcggtgcagccgggcgcggcgcgggcttcggctcggcctgcgcgatggcagccttctgttcggccgccttctgctgcgcggcggcttgttccgccgcctgctgctgggcttgcgcggccagcgcggcgctggccgccgcggccgtatcgacggccggctgcgacgcgatcagcgcggcctgggtctggccgttctgtgcgttgctgctgctggccttcgggaagatgcccgtgatcgcagccgtcgccgcgaggctggcgacgatgacggcgccggcggcggtggcgataagcgggtggaggcgttgcttttgcggcgtggtctgattctggttgtccatttttttctccgatgtcgatccggatcggcgctgcggcgtcgggccggatcccacgcttcgggctcgagcagacttggcgttcctgcgcctcgttctggtcccgtgtcatgcgtggtgacgcaaaggagtgtcgtccaccggcaagcggcgcgccgtatcaaggtgtaacgaattgcagcggggcgctggcgactatgacagggaaaacccggagaaggccgtcgcgacggggaataaaacggggaggatcgagagccggcggacgccggccgaagggatttacgcgtcgttacaaagctgacgcgtgcgcgccgcagggcgcggcgcacacgcgggcgcggcgatcagtcttcgcggcgcagatgcgggaacagcagcacgtcgcggatcgtcgggctgtcggtcagcagcatcacgagacggtcgatgccgatcccgcagccgccggtcggaggcatcccgtattcgagcgcacggatgtagtcggcgtcgaagaacatcgcttcctcgtcgcccgcatccttctgctcgacctgcttcttgaagcgtgcggcctggtcttccggatcgttcagctccgagaagccgttcgcgatttcgcggccggtcatgaacagctcgaaacgctcggtgatgcccggcaccgtatccgatgcgcgtgcgagcggcgacacttcgaccgggtaatcgatgatgaaggtcggctcccacagctgcgcttcggccgtttcctcgaagagcgcgagctgcagtgcgccggtacccgcgttcaggaacgccggctgcgacacgtcgacgccgaagcgcttcagttcggtgcgcaggaacgcgtcgtccgacagctggccgtcggtgtagtccggtgcatacttctggatcgcctgcgtgatcgtcaggcgatggaacggcttcgcgaggtcgagttcgcggccctggtactggatcgtcgcggtgccgagcgcatcgatcgccgcctggcggatcagttgctcggtgaagtccatcagccagcggtagtcggtgtacgcggcgtagaactccatcatcgtgaattccgggttgtgacgcggcgacacgccttcgttccggaagttacggttgatctcgaacacgcgctcgaagccgccgacgatcaggcgcttcaggtacagctccggcgcaatgcgcaggaacatctgcatgtcgagcgcattgtgatgcgtgacgaacggcttcgccgctgcgccgcccgggatcgggtgcagcatcggcgtttcgacttccatgaactcggcgttgtccatgaacttgcggatcgatgcgatcgtcttcgtgcgggcgcggaacgtgtcgcgcgtttccggcgtgacgatcaggtcgacgtagcgctggcggtagcgcatttcctggtcggacaggccgtggaacttgtccggcagcgggcgcagtgccttcgacagcaggcgcagttccttgcactggaccgacagttcgcccttgttggtgcggaacagcacgccacgcgcggcgacgatgtcgcccagatcccacttcttgaatgcgtcgtaggtttccgcgccgacgtcgttcggcgtcacgaagaactggatctggcccgacccatcctgcaccgtcgcgaagctcgccttgcccatcacgcgcttgagcatcatgcggccggccaccgacacctcgaccgggttcgcttcgagcgcggccttgtccgagtcggcgaatttcgcctgcaggtcggcagcgtggtgctcgggccggaaatcgttcgggtaggcgacgccttgctcgcgcagggcgcgcagcttctcgcggcgctcggcgatgatctggttttcgtccgcggtgacggcgggctgcgtttgggtcggttcggtcatgatggtcggaattcggagtgggtgcggcaacgcaaacgggaagggcaaggggcgcggcctggccaggccgcgccgcggcgcttacacgccctgtttgaggctcgcgctgatgaagtcgtcgaggtcgccgtcgaggacggctctcgtgttgctcatttcgacgttcgtgcgcaggtccttcacgcggctctggtcgagcacgtacgagcggatctgatggccccagcccacatcggtcttgctcgattcgagcttgtcctgttcggcctggcgcttgcgcatctcgacttcgtacaggcgcgacttcagcattgccatcgcttcggcgcggttgcggtgctgcgagcggtcgttctggcactgcacgacgataccggtcggcatgtgcgtgatccgcaccgcggagtcggtcttgttgatgtgctggccgcccgcgcccgatgcgcggtacgtgtcgatgcgcaggtcggccgggttgatctcgacttcgatcgagtcgtcgatttccggatagacgaacaccgacgagaacgacgtgtggcggccgcccgacgagtcgaacggcgacttgcgcacgaggcggtggatgcccgtttcggtgcgcaggaagccgtatgcgtattcgcccgagaccttgaccgtcgcgttcttgataccggcgacgtcgccgtcggactcttcgagcacttcggccttgaagcccttgcgttcgcagtagcgcaggtactggcgcagcagcatcgatgcccagtcgcacgcctcggtgccgccggcgccggcctggatgtcgatgaagcagttgttcgggtcggccgggttcgagaacatccggcggaactcgatgtcgccgacgcgcgcctcgagcttcgcggcgtcttcttccgacgcgatgagggtgtcttcgtcgccttcctcgcgggccagctcgaacaggtcgagcgcgtcgcgcaggtcgccgtcaagcgcggtgagcgtcgtgacgacgccctcgagcagcttcttctcgcgaccgagcgcctgggcgttcttcgaatcgttccagacgttcgggtcttcgagttccttgttgacttcggtcagacgcgcagcttttgcgtcgtagtcaaagataccccggagctcgcccgcgcgattgcgcaggtcgagcagggagctttcgatcgcgttgagacgttccgcttccatgatcgctcgctattcttgcttcgtaaaaagcggaattatagccgatcggcagggttgcccggtgacgcaaacggtgctcgtgcgtgcaccgcggccccgtccggcgcggcgcgcatgcatcggcgggcgctcagccggccgcgtgttcgacgatcagctggacgcgcgtgacgccgttccacgtgtcggcgacgagccggtacgcgaccagcgcgctttccggcaggggctccgtgtggttgaaccagatcgcgttgaagcgctggcggccgcgtgcaagctgcagtttcaggtgcttttccttcacgagcgactgggacacgacgtcgaattcgcccgagaaaagcggggccggaaagccttgcccccagacggcctcgtcgagcagcccgacgaactgcggcgtgaagtaggcgtcctcgagttcgccgtcggtctcgatcacgcgggcgagcgcgtcgtcggacagccattcgcgcgcgactgcctcgaacgcggcggcgaagcgcggcacgttctcggtgtcgagcgtgaggccggccgccatcgcgtggccgccgaacgcgacgatcaggtccggttcgcgtttcgacacgaggtcgagtgcatcgcgcaggtggaagccggcgatcgaccggcccgagcccttgacccgcttgccttcgtcgtccgcgtgcgcaaacgtgaacgacgggcggtggaatttttcttgagccgcccggcgacgatgccgatcacgccctggtgccactcggggttgaagagggtgatcgtgcatgcgtcggccgggtcgacgtcggcgagatcggcgagcgcctgctgctgcatgccggcctcgatctcgcggcgctcgcggttcatcacgtcgagctgttgcgccagatcccatgcgcggccgatgtcgtcggtgatcaggcactcgatgccgagcgacatgtcggagagccgcccggcggcgttcaggcgcgggccgaggccgaaaccgaggtcgaagcccgatgccgtgcgcgcttcgcgcgcggcggcgcggaacagcgcggcgacgcccggttgcatgcggccgttgcgaatgcgttgcagcccctgcgcgacgagcacgcggttgttgccgtcgagccgcacgacgtcggcgacggtgccgagcgcgacgaggtcgagcaggccgtcgaggcgcggctcggcttccttgctcgcaaaggcgccgcggcggcgcagctcggcgcgcagcgcgagcagcacgtagaacatcacgccgacgccggcgaggtgcttgctcgggaacgcgcagcccggctggttcgggttgacgatcgcgcgtgcggcgggcagtgcgtcgccgggcaggtggtgatcggtcacgagcacgtcgatgccgcgcgcgttcgcggcttcgacgcccgcgacgctcgcgatcccgttgtcgacggtgatcagcaggtcgggcttgcgcgcggcggcgagttcgacgatctcgggcgtgaggccgtagccgtattcgaagcggttcggcaccaggtagtcgatctgcgcgccgaacatccgcaggccgcgcaccgcgaccgcgcaagcggtcgcgccgtcgcagtcgtagtcggcgacgacgagcaggcgccgcttgtcggcgatcgcgtcggcgagcagcgacgccgcgtcggcgcagcctttcagctcggtgggcgggacgagccgcgcaagcgcggtctcgatgtcggcggggactgcacgccgcgcgacgcgtacaggcgcgcgagcacgggatgcaggccgtggcgcgcgagcgcttcggcgtcggcgggcgcgacggggcgggtaacgatccgggtcatacggggtgtgcttgttattcgaacagggaggccagcgcgcggcggcgccagaacttgcgcaggtctgagcgcgtcgcacgcagcgtcacggaactcgtgtcgccgcacagcgtgaaatcgacgcccgccagctcgccgttccgcagcgcggcgagggccggcgcgaaccagtcgcgctcgagcgcggcgagtccgtcgtgccagcgcgcccagtcctgctcgatgaacggggtggtcagcgccggcaggtcgacgagcgtcgcgccgtcggcagcgggcagtgcgccgaatgcggcgggcacgcccgaggcgtcgatccgcgcggcgcgcgcaaggccgagcgccgcgggcgatgcggacagcacgcgcgcgaacggctggccgaccggtttcagcgtgccctgcgcatggaaccagatcgagttgacggccggcagcccgcgcgcttcgcgcgcttcgttgaccgggtgctggaaccaggccatctgcacttcgttctgcagcttcatccacatccgcgagcgttcgcccgtatgcgcctcgtgcggcagccagatttcgatgttgcggccgctcgcgcgcagcggcgcggcgccggcgagtcgggcgagctgctcgctcgacaggtaccagcgtgacgggttcggcgcttcgagccgtacgccgagctcctcgatcagcggccgggcgaccgcgagcagcgcggccgcgtcgccgtcgtcgagcgcaagggccgccggatcgacgagcaccaggtgatcgtgcgcgatttcgacgtggacgggctcgacgcaggcccaggcccgggcgcccggatcgccgccgtccgccagcagcatgtagggcgcgagcggcgcctcgtcggcggcgttgccctgggtcgcgccgaactggcgggccagccagcgctcgtgcggcagcgtgcgctggaagtcctcgccggccacgcgctcgacgaggctcgcgcgggcgagcaacttttcgagcgcggggctgtccagcgtgtgcagggacgaggccgcatcggccgccgacggcagcgcgaacggaacgagaaaatggaggcgtcggtcgtgcatgatggtgcgcattgtatggcaaactgcgcgcgtgatcgggccggctgacggcccgttcgcgtccggcggccgtttttcgaccgtgcccgggccggtggccgccaccgggcggcggtccggccgcggggcgcctcccgccgtaaccagcagaaaggattcgcttgaaacttccgtacgaatggcagatcggctggcgctacacgcgcgccggcaaacgcacgaccggtaacggcttcatttccttcatcgcgctcgtgtcgatgctcgggatcgcgctcggtgtcgcggcactgatcgtcgtgctgtcggtgatgaacggcttccagaaggaagtgcgcgaccgcatgctgtcggtgctcgcgcacgtcgaggtgttctcgccgacgggctcgatgcccgactggcagctgaccgcgcaggaagcgcgccgcaatccgtcggtgatcggcgcggcgccgtacgtcgacgcgcaggcgctgctcactcgccaggacgcggtgagcggcgtgatgctgcgcggtgtcgagccgacgctcgagccgcaggtgtcggacatcggcaaggacatgaaggccggccagctcgccgcgctcgtgccgggccagttcggcatcgtgctcggcgatgcgcttgccggcaacctcggcgtgacggtcggcgacaaggtgacgctcgtcgcgccggagggttcgatcacgccggccggcatgatgccgcggctgaagcagttcacggtcgtcggcgtgttcgagtccgggcactacgaatacgacagcacgctcgcgatgatcaacatccgcgatgccgaggcgctgttccggatggccgcgccaaccggtgtgcggctgcggctgaaggacatgcagaaggcgccggacgtggcggtcgagctgtcgcatacgctgtcgggcagcctgtacatccgcgactggacccagcagaacaagacgtggttctcggccgtgcagatcgagaagcggatgatgttcatcatcctcacgctgatcatcgcggtggccgcgttcaacctcgtgtcgtcgctcgtgatgacggtgaccaacaagcaggccgacatcgcgatcctgcgcacgctcggcgcgcagccggggtcgatcatgaagatcttcgtcgtgcagggcgtgacgatcggcttcgtcggcacggcgtcgggcgtcgcgctcggctgcctgatcgcatggagcatcccgtggctgatcccgatgatcgagcacctgttcggcgtgcagttcctgccgccgtcggtgtacttcatcagcgagctgccgtcggaactcgtcgcgagcgacgtgatccggatcgggctgatcgcgttcgcgctgtcggctgtcgcgacgctctatccgagctggcgcggggcgaaggtgaagccggcggaggcccttcgctatgaatgatcgcgcgaccgcattcgcggattcacgacaacacaacacacaggattcggcaggtatgcaggaatacgtgcttcaggcgcgcgggatcacgaaggcgttcgtgcagggcggcttcaacgtgcaggtgctcgacaataccgagctgacggtgcggcgcggcgagaagcttgcggtcgtcggcgcgtcgggctccggcaagagcacgctgctgcacgtgctgggcgggctcgacgagccgagcgcgggcgaggtgtcgctgctcggcaagccgttcacgcaactcgccgagcgcgagcgcaacgaattgcgcaaccgtgcgctcggtttcgtctaccagttccatcacctgctgcccgagttcaccgcgctcgacaacgtcgcgatgccgctgcgcatccgccggatgacgaccgaggccgcgcgtgccgaggcccaggcgatgctcgaacgcgtcggtctcgggccgcgggcgaagcatcggccgggcgagctgtcgggtggcgagcggcagcgcgtcgcgatcgcgcgcgcgctggtcacgaagcccgcgtgcgtgctcgccgacgagccgaccggcaacctcgacggcacgacggccgatacggtgttcaacctgatgctcgaattgtcggaaacgctcgaaacgagcttcgtgatcgtcacgcacgatcccgatctcgccgcgcgctgcgaccgcatcatgcggctgcgcgacggcgtgctgcacgaggagccggcgttgccggtgtaagtgaacgccgctggccggctgtcgggttcgtcccggcgcggcgccagcgtgctggaacatcgccatgtggatcgatacgcactgccatctcgatgccgccgagttcgacgccgaccgcgacgcggtcgtacaggcggcgcacgcggccggcgtgtcgcgcatcgtgatcccgagcgtcgggcgcgacaacttcacgacggtgcgcgagcttgcgcaccgcacgccgggcgcggtctatgcgctcggcatccatccgatgtacacgccgcgcgcacgcgacgaggatctcgacctgttgcgcatggaaatcgaggcgagcctcgacgatccgcgcttcgtcgcgatcggcgagatcggactcgactatttcgtgccggggctcgacgacgcgcggcagcagttcttctaccaggggcagctgaagcttgcgcgcgaattcgacctgcccgtgctgtgtcacgtgcgcaagtcgcaggaccgcgtactggccgggctgcgtcgcttcggcgtgcggcgcggcatcgcgcatgcgttcaacggcagttttcagcaggccgaagcgtatctcgcgcacgggctgcatctcggcttcggcggcaacgtgacgttctcgcgggcgctgcagatccgccggctcgcgacgcagttgccgctcgaggcgatcgtcgtcgagacggacgcgcccgacatcgcgcccgaatgggcatacaaatcccgcaacacgcccgaccaggtgccgcgcatcggcgacgtgctcgccgaactgcgcgggatcgacaccggcgcgctctcctatgcacttcggctaacgcgcttgccgcgctgccgcgactcgctctttcgtccgcataatcgttgccggaaggcgccgtattcgcaatggcggcgccggatcgacgaggaggtgcgatgcgcgtgtggtggatcgcgttcgcgctcggcgtggtcgtactgcagcggcaggcgacgctgccgggtgcgttcgcatggacgatcggtgcgaccgtgctcgcgggctgcgtggtcctgggcgcgtggtgcatgcgccgccggcgtatgcgcatgaccgtcgcgttcggatggatgctttgcgcgctcgcggcctgcgtcgccggactcggctacgcggccgcgcgggccgaatggcggctggacgacagcctgcccgtcgagtgggaagggcgcgacatcgtcgtcaccggggtgatccggggctgcccgtggtcgacgacacaggtgcgcggctgctgttcgcggtcgagtcgaacgatgcggggctggcccgtttcccgccgttgatccgtctgtcgtggcgcgcgtatgacgcggccgcgacgcgcgacgcgctgcccgatctgcgcgccgcgcagcgctggcgtttcgtcgtgcgcctgaagcgcccgcatgcggaggccaatcccggcgtgcgcgacagcgaggcggcctggcttgccgcgggcattcgcgccgtcggttatgtcagcgcgccccggcgggcggtattgctcgatgcgcgcgcgtcgggatggcgtgcatcgatcgatcggctgcgcgacgtgctgcgctcgcgcatcggcgagacgcttggcggcgacgcaggccatcgcggcatcgtcgccgcgctcgcgatcggcgaccagtcgggcatcggcgacgacgactggcgcgtgttgcgcaacacgggcacgagccatctcgtcgcgatctccggcctgcatgtcgggctcgtcggcgcgatcgcgggcgggctggtgtcgatggtctggcgtcgcctgcgctggcgcgcccgggccgcgacgctcgtattgccggcgccgtacgcggccgcgctcgccgcgctgacggccgcggccggttatgcggcgctcgccggcttcaacgtgccggcgcagcgcgcatggtggatgatcgcggccggcggcattgcgtatctggccgggcgcagcgtgccggcttccgcggtgctgtgcgcgtcgctcggcggcgtactgcttgccgatccgtgggccgtgctgtcggccgggttctggctgtcgttcggggcggtcgccgtgatcctgctggcggtttccggctggcgtgccgtgcgcgaggccgatgcgcaaggcgatgggggtgaggagggtggcggcaccgctggcttgtcgaaccgggcgcgcgcgtggggtgcgcgcgccgggcgccgcatcgccgaggccacgcgcgtgcagtacgcggtgacgatcggcctcgcgccgctgacggccgcctggtttgcgcagatatcgctgtcgggcccgttcggcaatgcgttcgcgattccctgggtcagctcggtcgtgacgccggtcgtgctggccggcatcgcgctgccggcgccgttcgacgcctatgcgttccggcttgcgcacgcggcgctcgaaccgatgatgacgttgctgggatacctcgccgactggccggccggcgtgttctggttgcgcatgcccgactggccggtgctggcgttggcctgcgcgggcgtcgcatgggtgttgatgccgcgcggctggccgctgcgctgggctgcgccgctcacgtggctgccgctcgtcgcgccggcagccgatgcgccgccgccgggcggtttccggctgaccgtgctcgacgtcgggcagggcgcgtcggtgctggtggagaccgcccgacggaccttgctgttcgacgcgggaccgggcgcggagtcgacgcatgccggtgcgcggatcgtcgcgccggcattgcgctcgcgaggcatcgcggtggtcgattcgctcgtgctcagtcacgcgcacgccgatcacgcgggcggcgcgccggccgtctatgcggctaccgacgtgcgccagctgctggcgggcattccgccgacgagcgggctgtggcgcgatgcgatggccgccggcgttgccgaccggctgccgtgcgcggccgggcagcgctggacctgggacggcgtggtgttcacgatgctctggccatcgggcggtccgggcgcgggttcgtcgaacgggcagtcgtgcgtgctgcgcatcgacgcgggcgggacgtccgcgctgctgacgggcgacatcgaagcgcccgtcgaacgccagctcgtgggcacggcgcgcgacacgctggccgcgcagatcctggtcgttccgcaccacggcagccgcacgtcgtcggtcgagcctttcctcgattcggtcgggccgcgcgtcgcggtatttcctgtaggctatcgcaatcgtttcggacatccgcaccgggcggttctcgcacgttacgaggggcgcgggattccgctgccgcgcaccgatcgcgacggcgccgtgcggttcgacgtcgcgccggccgacggcgggtttgccttcgagcttcatcgcgacgttcggcggcgatactggatggatcggtgagcgcggcaagggccgcatcaattccggtcgacaagggagacatcggcgtttgaaggacatcctccatttctcgcatgcgaacggctttccggcgtcgacgtaccgcacgatcttcgccgaactggccgacgactacgagctgcgctacatcgaacggatcggccacgaccgccgctatccggtgacgcgcgactggccgcatctcgtcgagcaactgctcgacgacatcggcagccgctacgagcgtcccgtctggctcgtcggccattcgctcggcggctacctgtcgctgatggctgcgctgaagaagcctcaatgggtgcgcggcgtcgtgatgatcgattcgccgatcatcgcgggctggcgcgccggcgcattgcgtgcgagccagtgggcggggctcgacgagcggctgtcgccggcggccgcgacgcgcaaccggcgcacgcgctgggtgagccgtgacgaagtctggcggcactttcgtgagaaaccggcgttcgcccgctgggacgaacggatgctggccgactacatcgactacgggattccgcaggccggggccgacggcgagcgggcgctcgcgttcgaccggcaggtcgaatacctgatctaccggacgctgccgcacgctcggcccgaggctcgcgcacggcgcgccggtgccgctcggttttctcgccggcacgcgttcgcgcgaggtgcgccaggtcgggctcgatgcgacgcgccgcgcggcgcgcggccgcgtcgaatggctggaaggcagccacctgttcccgatggagcggccgctcgagaccgcccgcgcattgcagcggatgctgaattcgctgaaggcggccgagggcgacgtgtcgcagggcggcgccccgctcgcgaagcgcgcctgacgccgggccgggtgaccgggccgcgccgcctgtgcgtgcggctgcgccggccggcgggggcttcgccccggcgcccacggctggtgcggggcggcgcgaaagggcgcgatcatcgagtcaattgctgagagaagggcgggctttacggtataatccgtttttcccgcgagcattcagcgatgaccaaatatgttttcgtcaccggcggcgtagtttcttccctcggcaagggtattgccgccgcctcctcgccgcgatcctcgaatcgcgcggtctgaaagtcaccctcctcaaactcgatccctacatcaacgtcgaccccggcacgatgagcccgttccagcacggcgaagtgttcgtgacggaagacggagcggagaccgacctcgacctcggccactatgagcgcttcatcagcacgaagatgcgcaaggccaacaacttcacgaccggccagatctacgaatcggtgatccgcaaggagcgccgcggcgactatctcggcaagaccgtgcaggtgattccgcacatcacgaacgaaatccaggcgttcatcgagcgcggggcggcatcggccacctgcggcgaaccggatgtcgcgatcgtcgagatcggcggcacggtcggcgacatcgaatcgctgccgttccttgaagccgcgcgccagatgagcctgcgcctcggccgcaacagcgcgtgcttcgtgcacctgacgctggtgccgtacgtcgcgacggccggcgagctgaagacgaagccgacccagcacagcgtgcagaagctgcgcgagatcggcatcctgccgcacgtgctgctgtgccgtgcggaccgccgcattccggacgacgaatcgaagaagatctcgatgttctcgaacgtgccggaagacgccgtgatctcggtgtgggacgccgacagcatctacaagattccgcagatgctgcacgaccagggcctcgaccggatcatctgcgaggaactgaagctgtcgccgaaggacgccgacctgagcatgtggtcggaactcgtcgagaagctcgagaacccgaagcacgaagtgacgatcggcatggtcggcaagtacgtcgacctgaccgagtcgtacaagtcgctgatcgaggcgctgcgccacgcatcgctgcatacgtcgaccaaggtcaacatcgaatacatcgactcggaagagatcgagtcgaacggtgtcgacagcctgaagcacctcgacgccgtgctggtgccgggcggtttcggccgtcgcggcacggaaggcaagatcgcggcgatccgctatgcgcgtgaagccaaggtgccgtatctcggcatctgcctcggcatgcagctcgcggtgatcgaattcgcacgcgacgtcgttggcctgaagcaggcgaacagcacggaattcgagccggacacgccggaacgcgtggtcgcgctgatcaccgagtggtatgaccgcgacggcaaggtcgagacgcgcaccgaggaatccgacctcggcggcacgatgcgcctcggttcgcagcgctgcccgatcaagcccggcacgatggccgaggaaatctatggcaaggacgtgaacgaacgccatcgccaccgttatgaagtcaataaccgcttcgtgccccagctcgaagccggcggccttatcatcagcgcccgtaccccgagcgaggatctgccggaaatgatggagctgccgcgttcgatgcacccgtggttcgtcggcgtccagttccacccggaattcacgtccacgccgcgtgacggtcatcccctcttcaagtcgttcgtcgaagccgcgctcgccaacaagcaagcgcgcggagtgcaagcatgaagctgtgcgatttcgaggtcggtctcgacaaacctttcttcctgatcgcgggtacctgcgtcgtcgagtcggagcaaatgacgatcgacacggcaggccgcctgaaggaaatctgcgcgaagctgaacgttccgttcatctacaagtcgtcctacgacaaggcgaaccgcagctcgggcaagtcgtttcgtggcctcggaatggacgagggcctgcggatcctgtccgaggtgaagcgccagctcggcctgccggtgctgaccgacgtgcattcgatcgacgagatcgagcaggtcgcgtcggtcgtcgacgtgctgcagacgcccgcgttcctgtgccgccagaccgatttcatccaggcgtgcgcgcgctcgggcaagcccgtcaacatcaagaagggccagttcctcgcgccgcacgacatgaagaacgtgatcgacaaggcgcgcgacgccgcacgtgaagcggggctgtcggaagaccgcttcatggcgtgcgagcgcggtgtctcgttcggctacaacaatctcgtgtcggacatgcgttcgctcgcgatcatgcgcgagacgagcgccccggtcgtgttcgacgcgacccactcggtgcagttgccgggcgggcagggcacgagctcgggcggccagcgcgaattcgtgccggtgcttgcccgtgcggcagtcgcgacgggcgtcgcgggcctcttcatggaaacgcacccgaatccggccgaggcaaaatcggacggcccgaacgcggtgccgctgaaccggatgagcgcgctgctggagaccctcgtcacgctcgaccaggcggtgaagcgccatccgttcctggaaaacgatttcaattaaagatcgaatgaaccttgcgacggtttcgcgcgtcagtagcgaaagcggttcgggcgcgtgcgccgtcgcagtttgaagaatccatcgtcattctcagaggaaacccatgagtgcaatcgtagatatcatcggccgcgagattctggattcgcgcggcaaccccaccgtcgaatgcgacgtgctgctcgaatcgggcacgatgggccgcgcggccgtgccgtcgggcgcgtccaccggctcgcgtgaagcgatcgaactgcgcgacggcgaagccggccgctacaacggcaagggcgtgctgaaggcggtcgagcacatcaacaccgaaatctccgaagccatcatgggcctcgacgcgtcggaacaggcgttcctcgacaagacgctgctcgagctggacggcaccgacaacaagtcgcgcctcggcgcgaacgcgatgctggccgtgtcgatggccgtcgcgaaggcggccgccgaagaggccggcctgccgctgtaccgctacttcggcggttcgggcgcgatgcaactgccggtgccgatgatgaacatcgtcaacggcggcgcgcatgcgaacaacagcctcgacatccaggaattcatgatcgtcccggtgagccagccgacgttccgtgaagccctgcgttgcggcgcggaagtgttccacgcactgaagaagatcctgagcgaccgcggcatgagcacggcagtcggcgacgaaggcggcttcgcgccgaacttcggcagcaacgacgagtgcctgtcgacgatcctgcaggcgatcgagaaggccggctaccgtgcgggcgaagacgtgctgctcgcgctcgactgcgcggcatccgagttctatcacgacggcaagtaccagctcgcgggcgaaggcctgcaactgtcgtcggccgaattcaccgactacctcgcgacgctcgccgacaagttcccgatcgtgtcgatcgaggacggcatgcacgaaagcgactgggaaggctggaagctgctgaccgaccgcctcggcaagaaggtgcagctggtcggcgacgacctgttcgtcacgaacacgcgcatcctgaaggaaggcatcgagaagggcatcgcgaactcgatcctcatcaagatcaaccagatcggtacgctgaccgaaacgttcgcggccatcgaaatggcgaagcgcgcaggctacacggccgtgatctcgcaccgctcgggcgaaacggaagattcgacgatcgcggatatcgcggtcggcctgaacgccggtcagatcaagacgggttcgctgtcgcgcagcgaccgtatctcgaagtacaaccagctgctgcgcatcgaggaagatctcggcgacatcgcgagctacccgggtaaatcggctttctataacctgcgctaacgcgctactatcgggttcgtcatatcgacgccgctctgtgcatgtgcgcggagcggcgcttcttatatctgcgtttcttacatgcggcttgtcactgtcgtcctgattgccttgctggcgctcattcagtacccctatggtggggacacggcggctggctgcgggtgcatgaattgcgtcagcagctcgacgaccagctccagaagaatgcggacgagaagctgcgcaacgagcgcactgccggcgaagtgcaggatctgcagagcggcaccgcggccatcgaggagcgcgcgcgctacgagatgggcatggtgaaggacggcgaggtattcgtgcagttcgtgtcgccgaatgcgccggccgcgccgctgaacaacatgccgtcgaatacgtcgacgcgcggcgccgtgtccgcggcgccggtgcgcgtcgtgccgaatccgcagtcgatcgcgaagccgtcgcggcatcatggcggcgacaagggcaaggccgcgcatcactgatcacgatcgttcgaacccattgaaaaagcgcgggaaatgccgcgctttttatttcctgctggtagtcaatcggctgagcgatggatgctcaccaccaccatcccgggtagccgtagctgatacccgtgccccagcgattgccccatccgccgtaatacccgccgtagacggttacgggcggcggcgagtaataagcccacgcgcgcgcggctgcctcggctgccatcgcgctgttctgttcgcgcagcacctgctggtcgatctcgtcatagcgcttgcgttcggcgctcgacagcgcgggcggctggccgcccgatgcgccgggttcgggcaggcggctcaggatcgtggaagtcggcggcggcatcgcgcagccggcaagcgcgagcgtgcaggcggcaacgctcgtcaggacgacggttcgaaacgtgaggcgaagcgggcgattcatgtgtttctcctgcagcgcgccgacgacgggaagcggcttgcgccgaagtgcgggacttcggcgcgcgagccttgcgtgcgacgctcgtgcgtcattatgcgcccgtgcccggacggcgggcatcgggtcgccgctcagtgacgctgttcggtcgcgggcgcgatgcccgtctcgacgccgggtgccgcgaacagctgcgcgacgtcgaccggatcgaattcatagcgctgattgcagaactcgcaatggatctcgacgtggccacgctcgacgatcacgctgtcgacttcttcgcggccgagcatgcgcagcatcgcaccgaccttctcgcgcgagcacgagcactggaagcgcgtgccggccggctcgaagtgctgcacgttttcctgccagaacagccggcggaacacgacttccggttcgacctcgagcagttccttggcggacagcgtgccgccgagcgtgcagacgcgttcccacgtatcggtatcggtttcggcgttgcgcggcacgatgccgccgtcgcccggcagcttctgcagcagcatgccgaccgcacggtcgcgatcggccgcgagccacatccgcgtgtcgagctgctccgagtgatgcatgtaatgctcgagcacctgcgagacggattcgagcgggccgtcgacgccgttcagcggcacgatgccctggtacggctgctggcccggcagcttgtcggccgggtcgagcgtgatcacgcaacggccgtgaccgctcgcattgacgagcgatgcgaagctggtgtcgtcgccgatcgtctgggcggcgtcgccggcgaacttcgcggtggcccgcatcgacagatccgaaccgcactggacgaccagcatctggaccggcccgtcgccgaagatctgcatgatcagggtgccgttgaatttcaggttcgcggacagcagcgcgcatgcggccatcatctcgccgagcaccgtgcgcacgggggccgggtagtcgcggcgggagagcacttcctgccacgtattgcgcagcgaaacgatctcgccgcgcacgggcgccgcattgaacatgaatttctgtaactggtcgctcactcttcttccttgaaatccgtgcgaatcatccgattcgcacgagttgctctgaaatgcgcacgccgctcgacgtacgtcttcgcgttcgtgcgcagccgcgcgatgtcttccgccgtcagctcgcgcacgactttcgccggtgcgccgagaatcagcgaattgtccgggaaggtcttgccttccgtcacgaccgcgccggcaccaaccagacagttgcggccgatcaccgctccattcaagaccactacctgaatcccgaccagcgacccttcgccgatcgtgcagccgtgcagcatggcctggtgcccgatcgtcacgttttcggcaatcgtcagcggaaagcccgggtccgtatgcagtaccgcgccttcctggacgttgctgcccgcgccgacggtaatcgtctcgttgtcgccgcgaatcgtcgcaccgaaccagacgctcgcgttctcctcgagcacgaccttgccgatgatggccgccgtgtcggcgacgaatacgctttcgtggatcgtcggggccgtatcgcccagcttgtagatcgtcacggagtctccttgtctcttcgatgatgggcgccggtagaatggcgcgtccggtttgcccggcgcgttcgcattgcgccgcggaacaatcgcctattgtaaaccgtcgcgtgcgtgcgctcccgcgatgcgcgcgcagggtgtccccgtttatgagcatggagtcttcttctttcggcgatgcgcgtgcctgcgtgcgccgcgccgcgcttgtcgcactgcgtgacgcagaacccgcggccaaggccgcacaggtgcgctcgctccacgatgcgctgctggccgggcgggcgacgatcgccccatcgctcgaattgcccgagccggccgacctgcccgggcgcccggcgcgcccgccgcttgtcgagccgcgccagctcgagcgacgcagcatgcgttcgcccgaagggcgcgccgtgctgctgcacgcgcttgcccatatcgagttcaatgcgatcaacctcgcgctcgacgccgtctggcgcttcgcgggcctgccgaacgcgttctactcggactggctgaaggtggcggccgaggaggcgtaccacttcacgctgctgtcggaccgcctggcggcattcgggcatgcgtacggcgattttcccgcgcacaacggcctgtgggagatgtgcgagcgaaccaagggcgacgtgcttgcgcgcatggcgctcgtgccgcgtacgctcgaggcccgcgggctcgacgcatcgccgccgattcgcgcgcggctcgtacaggcgggcgacgaggcgtcggccgcgatcctcgacgtgatcctgcgcgacgaaatcggccatgtcgcgatcggcaaccgctggttccggcatctgtgcgacgaagccggccgcgatcccgtgccgacctaccggcagctcgccgagcaataccatgcaccgcggctgcgcggcccgttcaatttcgacgcacgccgcgatgccggattcgagcaggccgaactcgacgaactggccgcgcaggacggggcggacggaagcgcgccgcgctgacccgctcgggttcggctgcgtttcgaccgccgccggctgtccagggcacccggcagatggcgcgtcccggcggcccgtgcgcgccggcgccgctagagcggcgcctcgactgccggccgccggaaagaaagcgccgccgctataatcgaacgaccattcttttttgagcggctgcgatgagtgcctcgagttctgtttccgatttcgtcatggtgcgcggcgtccagctgcatgtccggcgctggggccggcccgatgcgccgacgctgttcatgctgcatggctggatggacgtcgcggcgtcgttccagttcgtcgtcgatgcgctcgcgggcgactggcaggtgatcgcgcccgatgcgcgcggcttcgggctatccgactggccggtcgcgcggcagggtggcggccactactggttccacgaatacctgggcgatctcgatgcgctcgtcgaccactatgcgccggccggcgaagtcaacctggtcgggcacagcatgggcgcgaacgtcgtgtgcctgtatgccggtgcacggccggagcgcgtgcggcgcgtggtcgatctcgagggtttcgggctcgcgcccgcgcgggccgagcaggcgccgcgccggctgcgcggctggctcgacgagttgcgcgaaccgcccgcgctgcgcccttatgcgtcactcgacgacgtggcggcgcgcctgaccaggaccaatccccggctggacccgcgtcgcgccgcgttcctcgccgcgcactggtcgaagcgcggcgacgacggcctctaccacctgctggccgaccccgctcacaagatgccgggcccgctgctgtaccggctcgacgaagtgatggctacctgggcgcaggtgcgtgcgaaggtgctgcacgtcgaggccgtcaactcgccgacgctcgcacacatcgccggcgatatcccgctgccggaattcaaggcgcgtttcaacgcgtttcccgactggcgcgagaagctcgtcgaggatgccggccacatggtgcatcacgaccagcccgagcagatcgcggcgctgatcgaggcgttctgcgcgtaagccgcgcggcgtcagcggcgggcaggcgggcggcgcattgccgcgttgcagtagaatgaagccttacctgccatgccgacaatgaacgccgatctccactgccattcgaatgtttccgacgggttgctgtcgcctgccgacgtcgcgcgccgcgcccatgccggcggcgtgaccctgtgggcgttgaccgaccacgacgaaatcggcggtcaggcggcggcgcgcagcgaggcggaagcgctcggcatgcgctacctgagcggcgtcgagatttcggtcacgtgggcggcgcgcaccgtgcacatcgtcggcctgaacgtcgatcccgcgaatccggtgcttgtcgacggcctgtatcgcacgcgccacggccgcgcggcgcgcgctggcgatcggcgagcagctcgccacgctcggcattcccggcgcgtacgaaggcgcgctgaagtacgtatcgaatcccgacctgatctcccgcacgcatttcgcgcggtttctcgtcgagaacggccatgccgaatcgacgtccgacgtgttcgatcgcctgctcggcgacggcaagcccgggttcgtcccgcaccgttgggcgacgctgcccgacgcggtcgcctggattcgggcggccggcggtgaagccgtggtcgcgcatccgggccgttatcgctatacgcccgtcgaattcgacgcgtttttcggcgagttcatcgatctgggcggccgcgcgatcgaggtcgtgacgggcagccacacgcccgaccagtaccgcgaatacgcggacgtcgcacgccgcttcggcttcgaggtatcgcgcggctcggatttccatgcgccaggcgagggccgcgtcgagctcggcggcctgccgccgctgccgcccgacctgacgccggtctgggagcgctggctctgacaccgggcggcggcctgccgcccgcgttgccgccggcgcgcgcatccgatttctcttcctttacgtacccccacgtacccccatgtcccagttcttcaggattcatccggataatccgcaaccgcgcctgatcaagcaggccgtggagatcgtcagcaagggcggcgtgatcgcgatgccgaccgattcgagctatgcgctcgcgtgccatctcgacgacaaggacgcggtcgagcgggtgcgccggattcgcggcctcgacgagaagcagcacctgtcgctgctcgtgcgcgacctgtcggagctcgccaacttcgcgatggtcgacaaccgccagtaccgccagatcaagtcggtgacgcccggcccgtacgtgttcatcctgcaggcgaccaaggaagtgccgcgccggctgtcgcatccgtcgcgcaagacgatcgggttgcgcgtgcccgatcacgcgatcacgctcgcgttgctggagtcgctcggccagccgctgctcggcacgacgctgatcctgccgccggacgacgagccgctcaacgatcccgaagacattcgcgcgcggctcgagaaacaggtcgatctcgtgatcgacggcggcgcgtgcccgcgcgagccgtcgacggtgatcgatctcaccggcgacgagcccgagctcgtgcgcgcggggcgcggcgcgctcgagccgttcggcctctcggcgccgtaagcgcgccgttccatttttgcgcgagtgcgcttgttacaataacgcgatatggatgcttccctgatacagaccatcgccgtctacgcactgcccgtgatcttcgcgatcacgctgcacgaggccgcgcacggctacgccgcccgcctgctcggcgacaacaccgcctacatgatggggcgcgtgtcgttcaacccgatgcgccacatcgatccgctcggcacgatcgcgattccgctcgcgatgtatttcctgacgggcggcgcgttcctgttcggctatgcgaagccggtgccggtgtcgttcggcaacctgcgcgatccgcgctggggcagcctgtgggtatcgctcgcggggccggcctgcaacttcgtgcaggcgctgatctggggcgtgctgacgctcgtgctgcccgccgtcggcatcgacgagccgttcttcacgcggatggcgtttgccggcgtcagcgcgaacctcgtgctgggcgtgctgaacctgtttccgctgccgccgctcgacggcggccgcatcctggcggcgctgctgccgacgaagcaatcgatcgcgctgtcgcgcatcgagccgtacggtttcatcatcgtcctcgcgctggtcgcgacgggcgtgctgacgaatttctggctgcgcccgctcgtcaacgtcggctacgccgtcctgagcgccatcctgtccccattcgcctcgcttttctaacgacaatcatgttccctgaacgtattttctccggcatgcgacccaccgggtcgctgcacctcggtcattaccacggcgtgctgaaaaactgggtgaagctgcagtccgagtacccgtgcttcttctgcgtcgtcgactggcatgcgctgacgacgcactacgagactcccgaggtcatcgagaagaacgtgtgggacgtgctgatcgactggcttgcgtccggcatcgatccggcccaggcgacgctgttcatccagagcaaggtgcccgaacatgccgaactcgcgctgctgctcggcatgagcacgccgctcggctggctcgaacgcgtgccgacctacaaggagcagatggagaagctgaaggacaaggatctgtcgacctacggtttcctcggctacccggtgctgatggcggccgacatcctgctgtatcgcggctcgctcgtgccggtcggtgaagaccaggtgccgcacgtcgagatgacgcgcgagatcgcgcgccgcttcaactacctgtacggccgcgagccgggcttcgaggagaaggcgctcgatgccgcgaagaaactcggcggcaagcgcgcgaagctctatcacgagctgcgcaatgcataccagcaggagggcgacgacgaggcgctcgaacaggcgcgcgcgatgctgcaggaatcgcagagtctgtcgatgagcgaccgcgagcgcctgttcggctatctcgaaggcgcgcgcaagatcatcctcgtcgagccgcaggcgctcctcaccgaagcatcgcggatgccgggtctcgacgggcagaagatgtccaagtcgtacggcaacacgatcggcctgcgtgaagacgccgagacgatcacgaagaaggtccgcacgatgccgaccgatcccgcgcgcgtgcgccgcaccgatccgggcgatcccgacaagtgcccggtgtggcagctgcaccaggtctatacggacgaagcgacgcacgactgggtgcagaagggctgtcgttccgcgggtatcggctgcctcgattgcaagcagccggtcgtcgaagggatcctgcgcgagcagcagccgatgctcgagcgtgcgcagaagtacatggacgatccgtcgctgctgcgcgcgatcgtcgcggacggttgcgacaaggcgcgcaagtacgcgacggaaacgatgcgcgacgtgcgcgacgcgatgggcctgtcgtacaactgatcgaccgcatgagcgcatccgtcatcgccgccgcgggcggccacgtcgcccaggccgagccgtcgcgctgggtcgcgcaatggtcgcggctcgtgccggcaggcggcgcggtgttggatgtcgccgcgggcggcgggcgtcatgcgcgctggttcgcgtcgcgcgggcatccggtcgtcgcactcgaccgcgacccggtcgcgctggccgcgttgcgtgcgattccgggcgtcgacgcccgtgacgccgatctcgaaggcgcgccgtggccattgccggccggcgagcagttttcggcggtgatcgtcacccattatctgcatcgtccgctctggccccatctgctcgatgcggtggcgccgggcggcgtgctcatctacgaaaccttcgcgcaaggaaacgaatcggtcggtaaaccgtccaaccccgcgttcctgctcgccccgggcgagctgctggatgccgtgcacggccgcctgcgggtggtggcgtacgaggacgggttcgttgccgcgccgcgcgaggcgttcgtccagcgtctctgcgcagtgcgcgagggcgcgaccccgaaggcgggggcgggaattccacgttacgaactgcccggctaatccgctacaatctcaacgtttaccggtacataacctcaatcgcgtttcatggctaacggcacccaagacggcattcaaatccgcggcagcatccccgcgatcgtcaccccgatgctcgaagacggcagtctcgacctgccggcgtttcgcaaactgatcgactggcatatcgcggaaggcaccgatgcgctcgtcgtggtcggtacgagcggcgagtcggcaacgctcaacgtcgaagagcacatcctgatgatccgcacggcggtcgagcatgcggcgaaacgcatcccgatcatcgcgggcgcgggcggcaactcgaccgccgaggcgatcgagctgacgaaacacgcgaaagccgtcggcgcggacgcgacgctgcaggtcgtgccgtactacaacaagccgacgcaggaaggcatgtaccgtcacttcaagacgatcgccgaagcggtcgacctgccggtgatcctgtacaacgtgccgggccgcacggtcgcggacatggcgaacgagacgatgctgcgcctcgcggaagtcccgggcatcatcggcgtgaaggaagcgaccggcaacatcgatcgcgccgcgcacctgatcaaggctgcaccgaagcatttcgcgatctatagcggcgacgatccgacggcaatcgcgctgatgctgctcggcggccacggcaacatctcggtcacggcgaacgtcgcaccgcgtgcgatgagcgagctgtgccgcgcggcgctggccggcgacgtacagacggcccgcgaactgcacatgaagctgctgtcgctgcacaagaacctgttcatcgaggcgaacccgattccggtgaagtgggcgctgcaggcgatgggcaagatgcagggcggcatccggctgccgctcacggcgctcgacgagcgctgccacgatgccgtgcgttcggccctcgtcgaggccggcgtcctcgcctgatgccgaggcggccgcgtcctgcggccgccggctcgtaccctgatcaacccgcaccggccggctccgtccggcgccgctcctgacgagcgttctagcaagacgaaggatttcatgaaacgtttcgccttttcctctcgcgccatccagatgtcggtggtggcgctggcgctgggcgcgctcgccggctgcgatacgctgaacgactatctggcccccgaccgggtcaactacaagaacaccggttcggcgccgccgctcgcggtgccgagcgacctgaagccggtgccgacgacgcagcagttcgtcgcgccgccgagcaacgccggcctcggcacgctgccgccgcgggccacgacccaggccggcaacgcgaccgacggcattccgagcgcgcaggatccgttcggcatgcacatcgagcgcgacggcgatcgccgctggctcgtcgtcgatggccggacgcccgagcagctgtggccgatcctgaaggagttctggcaggagaacggcttctcgctgaagaccgacgcgccgtcgacgggcatcatggccaccgactgggccgaaaaccgcgcgaacattcctgacgactggttccgtcgcacgatcggcaaggtcatcgatttcgcatactcgtccggtacgcgcgaccgcttccgtacgctcgtgaaccgcacgtcggacggcaacaccgacatctcgatcacgcacagcgcgatggaagaaatgatggtcggcccgcagggcggcacgtcgtcgcgctgggaggagcgtccgcgcaacccggtgctggaagccgtgttcctgtcgaagttgatgcagaagttcggcctgaccgatgcgcaggcgaagcagctgctgaccgatgcacgccccgcgacggcgccggcgcaggtcagcgacgcgagcaacggcgcggcaacgctgcagctggccgagtcgttcgaccgtgcgtggctgcgagtgggcctggcgctcgaccggaccaacttcacggtcgacaatcgcgaccgcgagaagggcgtgtacaccgtgcgctatgcgaattcgatggaagagctgaagcgtgacggcctgttcggcaagctgttctacggcggcccggcggccgcgaagccgggcaaggaattcctggtcaacgtgcgtgcgcaaggcaacggcggcacgcaggtcgcggtgatcggcgcaaacggccaggtcgacaactcgtcggacgcgcagcggatcatttcgctgctccacgcgcagctgaactgagcgcgtgcgattcgccagcctcggaagcggcagcgaaggcaacgcgctggtcgtcgaggcctcgagcggcacgacgaccactcgcgtgctgctcgactgcggcttttccgccaaggaggtcgagcgtcggctcggccgtctgaatctctgcatcggcgatctcgatgcgatcctgattacccacgaacacagcgaccacgtcggcagtgcgctgacgctcgcccgccgggcgtcgctgccgctctacatgagctggggcaccgcgcgcgcggtcggcgcggacgaggccgatgtcgacctccacgtgctgtggggcgacgagacggccgcgattcgcgatctggccgtgatgccctatacggtccctcacgacgcgcgcgagccgctccagttcgtctttatggacggctgcagccggctcggcgtgctgacggacgtcggcatggccacgccgcacatcacgacggtactgagcggttgtgacgcgctggtgctcgaatccaaccacgacaccgcaatgctggccgcgagccgctatccgcagtcgctgaaggcgcgcatcggcggcaaccacggccacctgagcaacgacgcggcggcggccatcctcgcatcgcttgagcgcagccgccttcggcacctggtcggggcgcacctgagccagcagaacaacctgccggaactggtccgccaggcgtttggcggcgtactggggacgaacggggaggacgtgatcgtggccacgcaggacgcgggcttcgactggctggcgctcgaatgagcggggcagggccgttgcggcggcccggtacgactgccgggcgacagacgcgaaaacggcagacgtaaaaaccggccctcgggccggtttttcagctgacgctgaggcttactggcttgcgcccgaagccggagcagccgtcgctgccgaagcagccgacgccactgcagcagcagcgtcgctcgcagcagccgttgccgacgaagcagcggcagcagcgtcgctcgctgcaccagcaactgccgaagcagccgtcgaagcagcagcagccgcgtcgcttgcagccgacgaagcagcttgatcagcgctcttgttgcaagcagccagtgcaacagcagccaacagggaagctacgaggagggatttcttcatgatcacgtccttttatggttaaaggtaagcaacagcgcgaaacaataccggtaatgtgctccaacaccgacctgggccgctggtggagatgcacttctagagcgtgaatcttccctacggcttgggcggaaattatatgcactttcctatcgaccgtcgacaaatgcggggtcaatacgttgtctttcccatacagaatttgatctgtacgggcatacggggcgactcacactaattccggtttccgacccgtatccagcccgcacgataccactcgtgcaataaagctgtcattgagggagcccgggatagtgttacaaaccgtttcgcctccatctggcgttgattggccagttcgggcagccattcgctggcttgctcgagcggtccttcctcgccattaatgaagtacgagcgcgcgttatacatcaatgcggcccttctgtcgagacacacgccacgacgtgacgcttgcgtgacgaacgcggcttcggacagcggacgcgcgggcgggtcgaaaacgacgttcggtttgggctcgctcaggtagcagccgagaaacgctgcgacgtcgcgcttgcgccagcgaatcgcgtcgacgatctcggcaacgcgctcgaccatcgccggaggcagttgcgcgggcgtgtcgacggccggctgcttcgggtcgcggtagaggtcgtcgccgcacccgtcccgcaggccgccacgctccgcgagatagtacaggaactgggcgcccagttcgcctgcggacggcgcccggaagccgatcgagcaggtcatgcattcgccttcggccacgccgtcgtgcgcgatgtgcggcggcaggtacagcatgtcgccgggttccagcacccattcgtcgctcggctcgaagttttcgaggatcttcagcggcacgtccggctgcagcgacaggtccttctgcgcgccgacgcgccagcggcgccggccctcgacctgcagcaggaagacgtcgtatgaatcgaaatgcgggccgacgccgccgccgtccgtcgcgtacgagatcatcaggtcgtccagccgcgcgtcggggatgaagcggaagcggtcgagcagcgcgcgcgccgcgtcgacgtgcaggtcgagcccttgtacgagcagggtccaggccttgcgcgtgacggccggcagcgagcccagttcgaacgggccgtgagccagttgccacttgttacgaaaatgggtgatcagtcgcgattccgcgtcatagtccgtggcgagctcgaacagcgcgtcgcgcgagaccggcgacgcgacgccggggatcgcctggcggatcaggagcggcttcttctgccagtagccgcgcatgaattgcgtcggcgtaagaccgccgagcagcggtgtgggaagatcggagggcggcgcgccgagcgggcggcagcggcatcccgcggttcggcttgagaccggttgcgcatcgtataatgagacttgtatttgggagaattggatgaaaatcgcaaaaacaccgtcgtgtcggtcacttacaagctgtcggatgcacagggcaatctgatcgaggaaagcgacgagccgatggtttatctgcacggcggctatgatggcacgttccccaagatcgaggaacagctcgacggccacgaaccgggctacgaggcacaggtccagctcgagccgcaggacgcgttcggcgactacgatcccgaactcgtgaagatcgagccgcgcgatcgttttcccgagccgctcgaagtgggcatgcagttcgaaggcacgccggaagacggcgacgaggaagtcgattcgctgatctatacggtcaccgacatcgccgaagacaaggtcgtgctcgacggcaaccacccgctggcaggcatggcgctgcgtttcgcgctgaccgtgaaggacgttcgcgaagccaccgaagacgaaatcgagcatgagcacgcacatggcgcggaagggctcgagatcgtcgacgaggacgaagacgaagacggcgaagcgccgtcagggcgcaccctgcactgagcttgcaggcaggccgggcgccggccccgacgctggggttggcacgggccacgacgcgccgcccggagcggtgccgtcgccctgcagcggcggcgcgactgacgacgagtcaggtagcgccggcaatgcagggatttccggcatctgcggcagcgggacgtcgtcacggggcacgagcggcagcgcgggcggcacgggcaggttcttcggtacttcctgcaggctcacgttgaagatcgtctgccgtgccggcgacacgctcaccttgacccactgattcaccggatggcgcggtccgatcgcgacgcgcgtcacgttaccgaccagttcaccgtcgtccgcacgcagcgggcggtcgatcagaaagccgttcgccagcgcttcgctgctcgcgtgcatcacgagtatcgggccgcggaacgtcgccgccgccttcaccagcgttcgtttcaactcgcggaagccgtcccgcacgcgcggccggttgaaacgcagccatgcgaagcgttccgcgcgttcatagcgttcgaactgcggatcgccttcgaatatcaccaccatcgcacgcgcctcgcgccgcttcgcgtattcggccgcgtggtcgatccagaaaccgttcgcgatgatgcggtcctcgaattcgccgttgcggccgccggccgtcaggtaatggttgttcggcgccggcgcgttgagtgcgacgtagacgatgtcgtcgcgcatccagcgtgcattttcccgatacggccggaaccgtgcgacttcactttcccgcgtgatcggcagcgcgccgggatcgggcagtgccgaatcggcgagcagcgtctgccgcaggaagtcgagccgctcgaccggatcgtagctaccgccggccacggtgttgcacgttgcccagtcgtcgtgaccgggaacgaatacgagcggcacgcgtgccgcatccaggatcgcgccgcgctgcgaatacagtgcatcgcggcacgcttccttcgaacccttgagatcgcccgcgtagaccacgaacgcgagattgcgctcgcgcgcgatcgcatcgagcagccgctgggcggccggttcgtccgcaggagtgttgatcacgcccgacacgaccgcgaacgagtagggcgcggtgctgcgcttcggcggcgcagccagcgcggcggcctgcgcgagcgcgagcaccgccgcgacgagcgcggcggcggcgcgtgccggcaggccgcgcggaatgcgcttacgcgtgcccgtcggcatcgtgcgaccggaccagcgtgcgcagttcgtacagcaggtcgagcgcctcgcgcggcttgagatcgtcgggatcgatgtcgcgcagtttttcgagcgccggatgcggtgtgtcgggcagcgccggtgcgtccgcgcattcgagatcgtcggcggccaccggcggcgcgctgaacaggtcgagctgcggcgtgtgctgcgacgccgactgctgttcgaggtacgcgaggtgcttgcgcgcggcacggatcacgggcgccggaacgcctgcgagctgtgcgacctgcaggccgtagctctggttggccgggccttcgttgaccgcgtgcaggaacacgatgccgtggccgtgctcgacggccgacaggtggacgttggccgcttgcggaaattccgccggcagttgcgtcagctcgaagtagtgcgtcgcgaacagcgtgtagcacgcgttgtgtgccagcaggtggcgcgcgatggcccacgcgagcgcgaggccgtcgaacgtcgacgtgccgcggccgatctcgtccatcagcacgaggctttgcggtgtcgcgtcgttgaggatcgccgcggcttcggtcatctcgaccatgaacgtcgagcggccgcccgcgagatcgtccgccgcgccgatgcgcgtgaagatccggtcgatcgggccgaagcatgccgacctggccggcacgtagctgccgacgtaagccatcagtgcgatcaacgcggtctgccgcatgaacgtcgacttaccgcccatgttcgggccggtgatcagcagcagcttgcgctcggtgccgaaccggcagtcgttcgcgatgaactgttcgacctgcgcctcgacgaccgggtggcggccctgttcgatttcgatgccgatctcgtcggtgaaggtcggcgcgacccagtcgagcgcgcgggcgcgttcggcgaatgcggcgagcaggtcgagttcggcgagcgccgatgcgacgcgctggcactcggggatgaacggcagcagtgcctgcagcactgcgtcgtacagcgcgcgttcgcgcgccagggcgcgttcctgcgcggacagcgccttgtcctcgaaagtcttcagttcgggcgtgatgtagcgctcggcattcttcaacgtctggcgtcggcgatagtcgtcgggcaccttgtcggtctggccgcgcgtgacctcgatgtagaagccgtgcaccttgttgtattcgacgcgcaggttcgcgatgccggtgcgcgtgcgctcgcgcgcttcgagatcgatcaggaactgtccgcagttctccgagatgtcgcgcagctcgtcgagctccgcgtcgtagccgcgcgcgatcacgccgccgtctcgcaccatcgcggccggttcgggcgcgatcgcgctcgtcagcaggtcgaggcattcggcgggcggtgcgagagccgcgtcgacgcgggtgagggcgtccgcgttcgcgacgattgcgctgatgcgctcgcgtagcgcgggagggcggcgaacgtgtcgcgcaggctcgacaagtcacgcgggcgcgcggacagcagtgcgaggcgcccggtgatccgttcgacgtcggcgatctggcgcagcgcgctgcgcagcgcatcgaggctcgcgtttgccggtgcatcgagcagcgcgccgatcgcctgctggcgcgactgtgcggcgaccgacgcgcgcggcgggtgatgcagccagtgacgcagcaggcggctgcccatcgtcgtgcagcaggtgtcgagcagcgaatacagggtcggtgattcggtgccgcgcagcgtctcggtcagttcgaggttgcggcgcgtggccggatcgagcccgatgtactcggtttcgttttcgaccttgaggctgcgcacatgccgcaactgctggccctgtgtggccgctgcgtagagcagcagcgcgccggccgcgccgcacgcgctcgtcagcgaatgtgcgccgaagccgtcgaggctcgcgacatcgagctggtcgcacaggcgctgcgtgcccgatgcgatgtcgaagtgccacgccggcacgcgcttgcttgcgcctgcgcctgcctgcacggcgtcggttgcgccatccggcgtcaggatctcggccggccggatgcgctcgagcgcggcagcgagctgctcgggttcgatttctgcgagccgcagcgcgccgcttgccagattcagccacgcgaggccgacattgaccgcgacgccacgcttgttgtggcccgtgcacatcgcgagcaggtaaacatcgttcttgtcggacagcagtgctgcatcggtcagcgtgccgggcgtgacgacgcgcacgaccttgcgctcgacggggcccttcgacgtggcgggatcgccgatctgttcgcagatcgcgaccgattcgcccatcttcacgagcttggcgagatactgttcgaccgcgtggtgcggtacgcccgccatcttgatcggcgtgccggcggatgcgccgcgttgcgtgagggtcaggtcgagcaggcgtgcggccttttccgcgtcttcgaagaacagctcgtagaagtcgcccatccggtagaagacaagcgtgtcgggatggtcggccttgatgcgcaggtactgctgcatcatcggggtgtggccggcgaaggcttcgggcgacagcgtggtcataggtcaggcatgaagttgttgcttgggttgcccgagtttaccagtggcgtcacgtgcgggcgtgaagttcgccgtttggccagttgcgggtgatgacgagcagcggcttgtcggccagcggcggcggttcgatattgtggttctcttcgtcgagaatcgaattgcgtctcacgtcctcaagacgttgacgggtaccccaatgcgaagcactgaaatgccggcgccccaccacgcggccatcgtcgtactcaacggtccgagcagcgcgggcaaaagcacgctgtccaggtatctgtgcgaaaacctgggcgagcatcatttgcacgtcgagctggatgtatttcgaaacatggagccgcccaactattgggcggtcgagaagccgttggcgcagattcgtgtggccgctctgtgtcgagcgatcaacgccaccgcggctacgttttccaggcatggccaggcggtgatagtcgatcatgtcttgtcgccggacgcgtggcgctacatgcttgaagatctggttgacctgccggtatttatcgtcggtgtttttgttcgctcgacgttctgatcgatcgcgagcgtattcgtggtgaccgcaagatcggacttgccgcgtctcagcacgacaagattcacgccggccgccactacgattacgtcgtggatacgtcgtcgacaaacgagatcgagtgcggtcagtccgttctgaaatggctgcaaagcgagccgttccctgccgccttctcgaaaatgcgccgggagtttttcggcgacgcggatgacgcaggtgtttgctggtaacggccgcgccccatagggcgagcggggtgcaggtttcagggcgataccttgccgggcaaggtgccggtacggctgcatcatccggctccgccccgccgaggccggcctcactcggcgcacgggcctttgcgtgccgagtgagtcagggcagatcagaacgcgccagccgatgtcaggctgagggccaccgcctgcgcaacttcgatgccgtcgatcgccgccgaataaatgccgcctgcatacccggcgccttcgccggccggatacaggccttcgacgttcatgctctggtaatcgtccttgcgtcgaatccggatcggtgacgacgtgcgcgtctccacaccggtgagcactgcatcgtgcatcgcaaagccggcgatcttcttgtcgatctggggcagggcttcacggatcgcctcgatcacgtagtccggcagcgcggtgctgagatcggtcgggttcacgcccggcttgtacgacggctccacggagcccagcgacgtcgacggtcggcctgcgatgaaatcgccgaccagttgacccggcgcgcggtaatcgccgccgccgagttcgaacgcgcgctcttcccatttgcgctggaacgcgatgcccgccagcgggccgccgggataatcgtccggcgtgatgccgacgacgatacccgcgttcgcgttgcgctcggcccgcgaatactggctcatgccgttggtgaccacgcggcccggctcggaggtcgccgcgaccacggtgccgccagggcacatgcagaagctgtagacggcgcggccgttgctgcagtggtggaccaccttgtagtcggcggcgccgagctgcttgtggcccgcgaacttgccgaagcggctgcgatcgatcagcccctgcggatgctcgatgcgaaaacccagcgagaacggcttggcttcgatatagacgccgcgatcgtgcagcatctggaaggtgtcgcgcgctgtggcctacggccagcaccacgtggtcgcaccgcagcgtttctccgttcgagagcttcagcgagcgcaccttgccctgatcgatctcgatgtcgtcgacccgcgtttcgaaacgcacttcaccacccagttcgtggatggacgcacgcatttttccaccatgctgacgaggcggaacgtgccgatatgcggccggctcagatacaggatgtcttccggggcgcctgctttgacgaattcgtccagcaccttgcggccatagtggttgggatccttgatctggctgtacagcttgccgtcggaaaacgtcccggccccgccttcgccgaactgcacgttggattcggggttgagcacgctcttgcgccacaggccgaaggtgtccttggtgcgctcgcgcacggccttgccgcgttcgaggatgatggggcggaaacccatctgcgcgaggatcagcccagcgaacaggccgcacggccccatgccgatcacgaccgggcgcaggaaattgccgtgctcgggcgccttcgtgacgaagtggtacgccatgtcgggcgtcacgccgcaatgcggcttgccggcgaggcgcttgatcgcggccgcttcgtccgcgacttcgacgtcgacgatatacgtgagcttgatgtcggcgcgcttgcgcgcatcgtgcgcacgacggaacacggtgtaacggaggagctcgtccgcggccacgccaagctccgcgaggcgcgcgcgaatcgcggcctcgagcgcgctttcggggtggtcgaggggagtttaatttcgcttagccgtaacatggggactcggatgcgattgccacggcgtcgtggcggtgttgatacggtcgggggccggcaggccggcggggttgtccgccgcgcgggcgtgccgcacgcaaacccgcacgcaaaccatttattgtcgttgcgggaacggcggtgtgggcggcagtacgctaccggccccgacaaactcaagcaacttcaggataggcgcacgaagcgacccttgtgcgggaagattttcccgcctcccggcaaccgggaggcgaacggtgcgccgtcgtgacgatgcccgcgagcggtgtgcgcgaaagccgcgccgcgcgggcgcggccggggcttactccgccgccggatgcacgcgggtgtagcggttcaggatcgggatcatctgcgcgtagatcttcgggttcgccgcgacgatttcatggcgatgcaggaaatcggcgtcgcccgtgtagttgccgacgaggccgccggcctcggtgatcagcaggctgcccgcagccatgtcccacacgttgatgccttgctcgaagaacgcgtcgaggcggccggccgcgacgttcgcgagatcgagtgctgccgcgcccggacgacgcaggccggtgcaggcttgcgtcatttcggtgaagaggcgcgcgtatgcatcgaggccgtccttttcgcggaacgggaagcccgtgccgaccagtgcgtccgacaggcggtcgcggcggccgacgcggatgcggcggtcgttcaggtacgcgccgcggccgcgcgtggccgtgaacaggtcgttcttgttcgggtcgtagacgacggcctgcgtgacgacgcccttgtgctcgagcgcaatcgacacgcagtagtacgggaagccgtggatgaagttggtcgtgccgtcgagcggatcgatgatccacttgaattcggattcgttctccgattcgcccgattcctcggcgaggatcgcgtggtcggggtaggcggtcttcagcgtctcgatgatcgcgtcttcggcggccttgtccacttcggtgacgaagtcgttctgctgcttcttgcggatctcgatcaggtcgagatcgagggacgcgcggttgatgatctgtccggcgcggcgcgcagccttgacagcgatgttgagcatgggatgcatgagcctggatcctgtagccggcggcacgggccgccacgaagtggaacaaccgcccggcacggcgcaagcgtggcaggcgaggtgagacgcgaattgacaaagaacggggtacgacccgcgccgcacggagtgcgacgcgtaaaggcatgattttacccgatttttggcggtttcaggcgaccgggatacgggaaaccccactatccatccggacgagtgggtttgccgcggcgatggcgataccatactgccattctgatgaaccgagtcgtatcgtagtggaaaccccgcagatcaccgccgcgccgtccgagccgggcgcggcctcgtcccggccgccgtccggcggcttcacgtccacccgtttcgtgctcgtcgagccgagccatcccggcaacgtcggggcggccgcccgcgcgctgaagacgatgggtttctcgcgtctggtgctggtcgcgccgcgtgtgccgcacgtccagagcgatcccgaggcgatcgcgatggccagcggcgcggacgacgtcctcgcctccgcgcatgtcgtgccgacgcttggcgacgcgctgtccggcgtgcactggtcgatcgcactgaccgcgcgtacacgcgaatacgggccgccgcgtctcgcgccgcgcgcggccgccacgcaggcgtgcgcacaggtcggcacgggcgacatcgcgctcgtgttcggcaacgagcgcacgggcctcgcgaacgagcacgtcgagcagtgcagcgcgctcgcgcacatcccggcgaacccggcctacagttcgctgaatctcgcacaggccgtgcaggtgctcgcgtacgagctgcgcgtcgcgtttctcgagcaggcgagcgagccgtcggcgcaagcgccggccgaagccggcacgctcgcgcagagcgacgagatcgagcggatgtacgtgcacctcgagaacgcgctgatcgcactcgatttcctcgatccgcgcaacccgaagaagctgatgccgcggttgcggcgcctgttcgcgcgcacgggcctcgagcgtgaggaggtcaatatcctgcgcggtatcgcgaagcacatcctgctgaaatcgggcaaaccgggcggcgacgcgtaagcggccggcgcacagtgcacgggccgcaggacggctcggcgcgcggggccgtttccctgtcgggcagatgctacgccggccgccggaagcgccgggccgaatcgcccggcctgttcggccatcccgcaaactcaatgccagcaagcgttccggccgaatacccgcgccgtcggcgggtgaacacgcgggctcgtgcggccgtgcgcgactcgccctacaatcgccgaacgtcataactaaattacccggcgcgataacggccggtcattgccggcgatgcgcgccggccttttcccagaccacatcatgttcacgagactgcgcgaagacgttgcaacgattcgcgagcgggatcccgccgctcgcagtgcatgggaagtgctgacctgttatccggggctgcatgcgctcgtactgcatcgtttcgcgcacgcatgctggcgcgcgaagcgctactggctcgcgcgtttcgcgtcacaggccggccggttcctgaccggcattgaaatccacccgggcgcgacgatcggccggcgtgtgtttatcgatcacggcatgggtgtcgtgatcggcgagacggcgatcatcggcgacgactgcacgatctatcagggcgtgacgctgggcggcacgtcgctcacgcgcggcgcgaagcgccacccgacgctcgaggccggcgtgatcgtcggcgcgggtgcgaaggtgctcggcggtttcacggtcggtgcgggcgcgaagatcggttcgaacgcggtcgtcgtgaagccggtgccggcaggtggcacggcggtcggcaatccggcgcgcatcgtgatgccggcgcagccgaagccgcagcccgaacgcgcggcgttctccgcgtacgggatcacgccgaatgccgacgatccgatgtcgctcgccattcacgggctgatcgatcacgctgcgaaggaaagccgccgcgtcgacgagatcgtcgcggcgctcgagcggctcggcacgcatctggaaacgctgcagggcgccgacgcggcgcgcctcgatctgcgccggctgtcggcggtgctggaaggcaagacggtcgagcgccaggcgtaatgtgatcgatgccggtcgcgacaggtcggttcgacggcggcggccgcgtcagtcgagcggcatcgcgtggatgccttccgcgtcgacacgcaggtaaccgccgcgcggcttgccgtggtcgagatcccagtcgggcaacacccagcgaatgccgcccggctcgctgtggcgcgcggggcggtgcgtgtggccgtgaatgatcacgctcgcgcggcttttccggaacagggcggccaccccttcacgcgtgacatcgtaaatcgccgaagcagggcgcatccggcccgcttcgctgttcgagcgcatgcggtgcgcgagcgcgcggcgccagcggaacggccatgcgagaaacagccattgcgcgacgcggttgcgtgcgaagcggcggaacagctggtagccgcgatcggccgtgcattgcgcgtcgccgtgcgcgagcacgatgcgctggccgaacgccatgatcagcgacgggtcgggcagcagcatcgcaccggctgccttcatgaagcgacggccgagcaggaaatcgcggttgccgtgcatcacgtagagcgcaattccgcgttccgagaacgtgtgcatcagcgcggccatgcgggccgcgaacggatcgtcgtcgaggatgtcgtcgccgatccagtattcgaacagatcaccgaggatgaacaccgagtcggcgctgtcggcggtgtatttcacgaaatgctcgaacgcggcgaccgtcttcggaatcgcttcgctcaggtgcagatcggagagaaacaggaacgggcgtgcggcttgcgcgtattcgcgctcgcccggcacgcccgcggagacgcttcgcggcggactctcctgcaacatcgaagtgcctccgttacgtgctgtgcgtcagaccacgacggccttttcgatcacgacgtcgtcggccggcacgtcctgatggaaaccggcgttgcccgtcttgacgcccttgatcttgtcgaccacgtcctggccttcgacaaccttgccgaacacggcgtagccccagccttgcggcgtcggcgacgagtggttcaggaagtcgttgtcgttcacgttgatgaagaactgggcggtcgccgagtgcggatcgttcgtgcgcgccatcgcgatcgtgtagttgtcgttcttcaggccgttgttcgcttcgttgtcgatcggcgcgtcggtcggcttctgcttcaggcccggctcgaagccgccgccctggatcatgaagccgttgatcacgcgatggaacacggtgccgtcgtagtggcccttcttcacgtagttcaggaagttttcgaccgtcttcggtgccttcgcggcgtcgagctcgagcttgatcacgccgtggttcgtatgcagttcaaccatgatgaattccttcggtgaggcggtttaaatggcacgcggccggtcgtgcgacgcggccgcgtgaggcgccggacgtgccggcaggttcttacttcgagacgacgctcgccgattcgatcacgatcggttgtgcgggcacgtcctgcatcgggccgcgcgaggtcgtcgcgacgccttcgatcttcttcacgacgtcgagacccgacacgaccttgccgaacaccgcataaccgttgccgtccgggttcgggtagtcgaggccgctgttgtcgaccgtgttgatgaagaactgcgcggtggccgagttcggatcgctcgtgcgcgccatcgcgatcgtgcccgtcaggttcttcagaccattgcggctttccagcgggatcggcgcgcgggtcggcttctcctcgaagttggtcttgtagccgccgccctggatcatgaagcccttgatcacgcgatggaagatcgtgccgttgtactggccggccttcacgtaatcgaggaagttggcgaccgatttcggcgccttctccgggtagagctcgacgcggatgtcgccctgcgaggtcttcagctgcacgacggggtgcgcggtagccgattgcgcgaacgcaggtgcggtcgcggtcgcgagaaggcggcgccgccaagcgccagcaacagacgtttcattgcgatcctcaggttgggagggaagaaggccgcgccgcttattgcgacggcgcgacgtacggcgccgccagtgcgcccgacggaccgctgaactggaacgtcggcgacatcggcagcgtggtggtgctcacgttcgcggcggcgcggtcggagtagtcgcgcgtggccggtgaggccgcgcgggcgttcggcgcggtcttcggcggcgacacgatcttctggagatcggcgaggcgctgcgcggtcgcgccgctcgtgcggccgagcgattgcgcacgcttgtacgactcggccgcgaggcgcaggtaaagatcgccgaggttctcgtatgcgagcgagtagctcgggttcgcttgtgtcgccgtgacgagcgcggtgcgcgcttcgtcgtatcggccatgcttcgcgtaaagcgccgcaaggttgttgtacggctcgggcagttcggggtacgcctgcgtgatcgcgacgaactgctggatcgcgtcgtcgtcgcggttcaggcgggccagcacggtgccgcgcttgaactgtgcctgcaggtcgtgcggattcgaagcgatgcgcgcgtcgagctgcgcgagcgcctgcttccactgcttgccggcgatcgacgcgtcgatttcggggtgccgtcggcggtggccggggccttctgcgcatgcgctgcgggggccgcgaacagcgtcagcgcgacgcccatgacggtggtcgcaacgagggtcgcagcgctcggcgcgcggccgcgatgaggtttcataggcgtaaatcggaatgttatactccgagccattctaacaaaacgtctgcgcgttccggcgagccgcaggcagtctttcttagcctctcgtggccgtcaccgctgtgcttgcagcctgaccgccccatgtgatatcgaggacgctcggcctggtgccgcagcagatggtccgtccgtttcgcatgctgggcgagcttcgccagggcggtttccttcggctcacggttcatctctatggaatcactgcgcatctacaacacgctcgcgcgtgacaagcaagttttcgtgccgcgccagcccggcgaagtgcggatgtacgtatgcggaatcaccgtatcgactattgtcacgtgggccacgcgcgcatgctggtcgtgttcgacctcgtccagcgctggttgcgtgcgatcggttaccgggtcacgtatgtgcgcaacatcaccgacatcgacgacaagatcatccgccgcgcggtcgagaacggcgagacgatcaagtcgctgaccgaccggttcatcggcgcgatgcacgacgacgaaagcgcgctcggcatccagcggcccgacatcgagccgcgggcgacggcgttcattccgcagatgctcggcatgatcgagacgctcgagacgaacggatacgcgtatcaggcgaccgacggcgacgtcaattactcggtgcgcaagttcgcgaactacggaaagctgtcgggcaagtcgctcgacgatctccgcgcgggcgagcgcgtcgccgcgaacgacgcgaaggaagatccgctcgacttcgtgctgtggaagcgggcgaagccggaagatccggaaggcgcgtcgtgggcgtcgaagtacgggatgggccgcccgggctggcacatcgagtgctcggcgatgggctgcacgctgctcggcgaacatttcgacatccatggcggcgggcaggatctgcaattcccgcaccacgagaacgagatcgcgcagagcgaaggcgcgaccggccagacgttcgtcaattactggatgcacaacggcttcgtgcaggtcgacaacgagaagatgtcgaaatcgctcggcaacttcttcacgatccgcgaagtgctcgagcgctacgacgcggaagtcatgcgtttcttcatcgtgcgcacgcactaccgttcgcctctcaattacagcgacgtgcatctcgacgatgcgcgcgcgtcgctcacgcgcctctacaccgcgctgaaggacgttgatgccgacacgctcgcgctcgactggaacgagccgcacgcgcagcgtttcgcggccgcgatgaacgacgacttcaacacgccggtcgcggtggcgacgttgttcgagctggcgggcgaggtgaatcgcacgcgcgacgcatcgctcgcgcggcaactgaaacaactggcggggctgctcggcctgctgggccgcgaaccgcgcacgttcctgcagcaggcgtcgggtgccgcgcaggcggcgggctcgccgccgacgagatcgaagcgaagatcgccgcgcgcgtcgcggcgaaacaagcgaaggactatgccgaagcggaccggatccgggcggaactgctcgagaccggtatcgcacttgaagacaaaccgggcggatcgaccgaatggcgtcgcgtatgagcgcggtgcgttccactgaccgatccgtcaggtaggaggcaagatggcaacggccagaaaagcgccggtcaggcgcgcgaccccggtcgccgcgcgtccggcagccaagcgcgtgccgccggtgaagacggacgcaacgcgcgccgtgccgaacggcgcgctcaacggtcatgcgcagcccgcggccgcgcagccggccgccgatgcggcccgcaaggcccgtgcgtccgaagcggacggcgaggaggtcgtcgtgcgtcctgcttactgggacaaggcatgcgccgacctcgtcaagcgcgaccggatcctgaagaaactgattccgaagttcggtcccgcgcatctcgtgaagcgcggcgacccgttcgtcacgcttgcgcgctcggtcgtcggccagcagatttcggtgccgtcggcgcagtcgctgtgggcgcgcatcggggatgcctgtccgaaactcgcgccgcaaccggtgatccggctcggcgcggacaagctgatcgcgtgcgggctgtcgaagcgcaagacggaatacatcctcgatctcgcgcagcatttcgtgtcgggcgcgctgcacgtcgacaaatggacgtcgatggacgacgaggacgtgatcgcggaactcacgcagatccgcggcatcagccgctggacggccgagatgttcctgatcttcaacctgtcgcggccggatgtcctgccgctcgacgacccgggcctgatccgcgcgatcagcgtcaattacttcagcggggaacccgtcacgcgcagcgaggcgcgtgaagtcgcggccaactgggaaccgtggcgcaccgttgcgacctggtacatgtggcgcagcctcgatgcgcccgacgccgacgcctgagcggcggctatcgggttttaaacatcaatagttgagagccggttttgagcgtcgcccgcgcgggtagaatacgcgctgccgcaagacccaaggattcgaacacatgaagaccacgtttctggatttcgaacagccgatcgccgaactcgaggccaagatcgaagagctgcgattcgtgcaggacgactcggctgtcgacatttcggaagaaatcgagcggctgtcgaagaaaagccagcaactgacgaaagacctctacgcgaacctgtcgccgtggcaggtttcgcagatcgcgcggcatccgcagcgcccgtacacgctcgattacgttgcggaactgtttaccgattttcacgagctgcacggcgaccgcgcattcgcggacgacctgtcgatcgtcggcggtctcgcgcgcttcggcggccatccgtgcatggtgatcggtcaccagaagggccgtgacacgaaggagcgtgccgcgcgcaacttcgggatgccgcgtccggaaggctatcgcaaggccgagcgcctgatgcgtctcgccgagaagttcgggctgccgatcttcacgttcgtcgacacgccgggcgcgtacccgggcatcggcgcggaagagcgcggccagtcggaggcgatcggccgcaacctgtacgtgatggccgagctgaagacgccgatcatcacgacggtgatcggcgagggcggttcgggcggcgcgctcgcgatcgcggtggccgataccgtgatgatgctgcagttctcgacctactcggtgatctcgccggaaggctgcgcgtcgatcctgtggaagagcgcagcgaaggcgccggaagccgcggaagcgctcggcctgaccgcgcaccgcctgaaggcgctcggcctgatcgacaagatcatcaacgagccgctcggcggcgcgcatcgcgatccgaagggcatggctgtgctgctgcgccgcgcgctcgccgattcgctgcgccagttccagggcatgagcatcgatgcgctgcgcgagcgtcgcttcgagcgcctgatggcctacggcaagttcaaggaaaccacgccgggcgcatgaccggccgtgtgttcaatacgcgcgccgctgcgcgcgcattcctctcgtgatcccaccgaccgaattctccgccgaccgcgtcgtcctcgacgcggtcggcgttgcgctttccggcatgccgcccgatgcgcgcatcgcgatcgcgtacagcggcggcctcgactcgacggtgttgctcgatgcggccgtgcgcgtcgcgggcgcgtcgcgctgcgtcgcgctgcacgttcaccacgggctgagtgcgaacgccgatgcctgggttgcgcatgccgaggcgagcgcggccgggctcggcgtcgcattcgaatcaatgtgcgtcgacgtcccgcgcgacagcggcctcggtgtcgaggcgacagcgcgcgagcggcgctatgcggcgctcgacgagatgtgcgaacgccacggcgcggccgcgctgtggcttgcgcagcatgcggacgaccaggccgagaccgtgttgctgcagttgttgcgcggcgcggggatcgcggggcttgccgcgatggcgccgcgttaccgccccgacggcgtgagcgtcgagcgcgtgcgcccgctgctgcgactgctgcgcgcacaactcgagcgttatgcggcgcagcgcgcgctcgaatggatcgacgacgaatcgaacaacgacacgcgttacgcgcgcaatgcgctgcgcatcgacgtgctgccggcgctggccgtgcatttcccgggctttcgcgacgcgctgggccgcgcggcccagcacgcggccgccgcccagcggctgctcgacgatctggctgaactcgacttcgccgttgccgcgcgcgatgatgggcaggcgctgtcacgcgatgcactggttgcgttcgacgatacgcgtggcgcgaacctgctgcgcttctggatgcgccggctcggtttgccgggcgcgtcggccgcccggctcgccaacatgatgcggcagttgcgtgccgcacacgatgcccatgcattgcgcgtcgatcacgcggggcaatgcctgcggctttatcgcgatgtcgtctactgggaagcgggcgacagcagcgagccggccgacgacggcaccggcacccccatccggacgcgtcgctcgcgtgggacgggcaggaggtctggcacctgccgggatggcgcggcacgttcgtgttcgcgccggtcaacgcggcaagcgccgatgcggtgccggaggcgctgctgcgcggcgcgcggctcgtggcgcgcgcccgcgcgggcggcgagcggatgcgcacgtcgccgggcgggccgggccgcacgttgaagaacctgttccaggagcgcggcgtgccggcctggcagcgcgacgtgccgctcttgttcgcgggcgagcggctgatctacgtgccgcggctcggcatcaatcgcgatgtcggcgcgttcggcagcgaggcggccggcgacggcatctggcgccggatcgaatggcgtcccgacctgctgatcgcgtaacggcgggcaggcttccggcggcgcgatggcgcgcgcattttcaccatttggtaaacagcgccggaacggctccggacgcggcgagcggcttgtcaagcgggcctctatcgggtacgctcggtcgtttgctcggctcgatttttgagcgatttgtgcaggttttccgcgtgacgtacccggtttgcgcggcctgatcggccttccgggcaaaatccgtcacgcttgcgtgttgcgtcccagccgtctccctcgtcgtccgtccacagccacaagccgcgtgaccgaacggctacgcggcctgcccagcgcgcccgtgcggtttctcctccagttcagaacgacaatggcactcatcgtacacaaatacggcggcacttcgatgggctcggtcgagcgcatcaagaacgtcgcgaaacgcgtcgcaaaatggcatcaggccgggcaccagatggtggtcgtgccttcggcgatgtccggcgaaaccaaccgtctgctcggtcttgcgaaagagatttcgagccagccgagcccgcgcgagctcgacatgatcgcgtcgaccggcgagcaggtcagcgtcggcctgctgtcgatcgcgctgcaggaaatcggcgtcgaggccgtgagctacgcgggctggcaagtgccgatcaagacggacagcgcgttcacgaaagcgcgcattcactcgatcgatgacgagcgcgtgaaggccgatctgaatgcaggcaaggtcgtgatcatcacgggcttccagggcgtcgatccggacggccacatcacgacgctgggccgtggcggctcggatacgtcggcggtggcggtcgcggctgcgctgggtgccgaagagtgcctgatttacacggacgtcgacggcgtctacacgaccgacccgcgcgtcgtcgaagaggcgcgacgcctcgatcgcgtgacgttcgaggaaatgctggaaatggccagcctcggctcgaaggtcctgcagatccgctcggtcgaattcgccggcaaataccaggtgaagacgcgcgtgctgtcgagcctgaccgatccgctgattgcgctcgacgaagaaatgcgctcgggcaccctgattacttttgaagaagacgagaccatggaaaaggcagtcatttccggcatcgcgttccagcgcgacgaagcacgcattgctgtgatgggcgtgcccgacaagccgggcatcgcgtatcagatcctcggcccggtcgcggatgcgaacgtcgacgtcgacatgatcatccagaaccagagcgtccagggcaagaccgactttacgttcacggtcggccgcggcgactaccagaaggcgatggacatcctcaccaaccaggtgaagggccacgtgaacgccgagcaggtgcagggcgatccgaaggtgtcgaaggtgtcggtggtcggtgtcggcatgcgttcgcacgtgggcgtcgcgagcaagatgttccgcacgctgtcggaagagggcatcaacatccagatgatctcgacgtccgaaatcaagatttcggtgctgatcgacgagaaatacatggagctggccgtccgcgcgttgcacaaggcattcgaactcgaccaggcatcgtgaattttcgtgatgcattgaagaaaatgcatcacggaaattgacgtgcggttcgaaaccctatattatttcgttctcgtcgcactgcctccctggtgcgagcgaaagtttgggagacgtggccgagaggtcgaaggcactccctgctaagggagcatctgggccaaaacctggatcgagggttcgaatccctccgtctccgccaaaagcggtgacaaagccccgcaagttctcggacttgcggggctttctttgaccatcaaatcaactcacaagcttcctgtgagcatgagcacgacgaacgagcggttcaccggtcgcagtcgttctgatgccgagtgaatattcgcgcggtgaagggtgatcactcgtcaagcggcgatccgtgtccgcgtgcggcatgcttgagccggactcggtgatttcctgaaccatctcaagtcgactcgagaaagtgagctccttcggctgggttcccggaaggttgggtgtttggcggcttccagtcttccagactcagttcggatgagccatcgatacaacctgtcgaagcttcgcagctaacccggcggtatcgtgcgactggcgcgaatacgagccggccttgccatgcaaaaactcaactgcgcagctgctcgcccttgataaaggcaatcagggcgcgcagagcctgcgagacatgacgatggccgggatagtaaaggcatagtcccggaaaaggcggacaccagtcgtcaagaacgcgttcgaggcgtccgtcacgcaaggcctcgacgacgaggtggtcagggacgaaagcgatgcctatgccgtccatggcggcgtcgaccatcagcggttggtccgtcaaagtaagcgggcccgagacatcgatggtctcgctcacgccgcgtcgctcgaattcccactggtagatcgcgccgctctcgaagcgaaagcgaatacagtcgtgtcgataaagatcgtgcggcgtagtggggcgtccatgtgcagcgaaatacgcgggcgacgcgactgctgcgaaacgaacgttgcccatgatcggaacggccaccatgtcctgcggcacggcctcggccagtcggatgcccgcgtcgaatcccgctgcaacgatgtcaccgaggcggccgtcgctcacgatgtcgagatgcacatccggatacgacttcaggaagcttgccaggatgggacgcaggatgaggcggatagcgccttcgcttgcattgatgcgcacggttccgctgggagccagacggagatcgtcgacttcgcgcatcgcttcgtcaatgatcgaaaccgccggccggagtttggctgccaggcgctcgccggcctcggtgagcgaggtgctgcgagtcgttcgattcaggagccggacgcccagacgccgctcgagcgcttttaccgaatgactgaccgctgacggcgtgatctcgagttcggtcgctgctgcgcgaaagcttcgtcgtgttgcaacggccaggaacacggtgaaagagaaaaatcgaagctccttgattggtgagtaactctcatcgtttcatcaagcattggtgatcttgttttgatactaggggctccctacactgggtgcaactatttcagtcaaggagcgccagatgtctcgaaagatattgatcacgggtgccagctcaggttttgggcgtggtgcggcaatcgaacttgcacgccttggccaccacgtcgtggcgacggccgaaacgtggccgcaggttcgcagcctgcgtgcggacgcagccgaggccggtgtggtgctcgaggtgatcaagctgaatctgctcgacgcgatcgacatcgctcacgcgggctcgttcgatcccgatgtcctggtgctgaacgccggcgtcatggaaggcggatcgatcgtcgacatcccgatgcagcgcgttcgggagtccttcgaaatcaacgtcttcggccatcttcaactggtacaggcgatcgtgccgaagatggtggcacgcaggtccggaaaagtcgtatggacctcgtcgatgggggcattctggttgtcccgtttgtcggtgcctactgcgcgaccaagcatgcgatcgaggccatcgccgggtcgatgaaagcggaactcgaaccctttggcgtcaaagtcgcgaccgtgaatccaggcgttttcggtaccggattcaacgacactggcgccgagagctacgtacagtggtacgacgccgattctgccgttgtgccgatgccggatttcagcgacagcctgatgaaccaggccgaccccagggagatgatcgacgccatggtcgagatcattccggccgatacgcatttgtatcgaaccatgcgcccctttgcgacgattgacgcggcgaagcagtggcaagagacggagtggacgcaaaatgcctgagctcacgctggagcgggcggatcggatcgtggcccaagggcgtgccgcagcccaggacgcgggactcaatgccgtgtttgcaattctggatgcgggtgcgcacctggtcactttctcgcggatggacggggcatggcttgcgtcgaatgaactgtcgattgcaaaggcccgggcttcggtgatgttccgggcgccgagcgaagcgctcaatgtcccgtggcaggcgggccagccagttccacacttcgaccacatccatgcaggcgggctgttgctgatgggaggaggagtgcctctcttggatggcgatggccaactgatcggcgccctcggcgtgtccggcggtacacccgagcaagatgcggtacttgctcgtgctgcgattgcctgagcgctggaggtggtgggcgagactccgatacctcggctatcgcgtcgatccgcggcgacacgtcacggtttcgtcgtcggcatgttgtgggcgctggcccgcttggcgtgccagtcgtcctgtgtatcgcgcggttgtgtactcgcgcaggaagaaatattcacggcccgcgtcaagaatgtatatctgcgatgcgtaaggtgagggcgcgacagcctgccgcgatggtggatgacccgcgcgcgttggaatattcactgcgcgcactgaaaatacacacgcgccatgcaggtagcgggtgcgcatccgcccgctgtggtggcggctggcgcaagcgaccccatatttacttcgacagcacggatgttgcgcgaccggttgttcgggccgcgcttcggttcaaccgtcgatttcgctcgaatcgaacgtgatttgcacatcatggtccgcaggccggtacgacgcggcgtaaccacactgtttgccagcgaagatgatcgtgcgcttgcagaccggcgaattgaagtccaccggcgtttgctcgatcagcctggtgtccgggcaggatgcggacacgttcggcagcttctgttgcgcggattcgctcgcctgattcgcgtccatcccacgatctttcgcggtgcgcgcccgctgagcagcagtggatgcacgatggtctccgatcgtattttcacgggcagcgtcgctgttggcgtttcgccgctttcgctgcggttgcagtttctgcggcgcattctgcgcgcttggcaaccatcatcacgccgaccatcggcgcctgacagcggttggcgtcgcaaattgctccggctccttgccgagcggaaaggcgactacgtaaagcacgttgatgggtatcggcttgctgttctagtcctccccacgggagcgtggagggtgggcggcgcggccattcactcgatccgcgtcgagcaagacgaaatgaaataaaaatgaaagttaatctgtaagaaatcagcgctgcattctcgccgtcttgtctggtgccaatcagctcgttccgaccctccggaatggcaggcggatgtcaaaaatgcggcgctgcgtcgatttttgcaatctgtctgatcgatcaatacaaaaattactcataaaaatcagcaagataaggtgggttttgaaaatcgatgctctgctgcgatgcagaaaataatcaatcgccttatgctggttaacccgatcgcgtttgagcggcgtcaagctttcccgtgatgctgctttacattttgccaacattggcgattcacgaaatctttctgtcgatttgatttcgttcctttcgtctcgcctgtctccgatgcagtgcgcgacttcatcaaggccctgttgacatgcatgatttcccttcctgagcctggccatctgggctccgatcctgttcggcgcgtgcctgctgcgcgccggttccgaccatcatccacgtcgaacgcggctgatcgcgctcgtcggcgcgctggtggggcttgcggccgtcgttccgctggtcgccggtttcgatgcgcactcggccgcgatgcagttcgtcgagagccgcaactggctggcggcgttcaattccggatggcgggtcggcatcgacggcgcgtcgctgtggctcgtcgtgctgaccgcgttcacgacgctcgtggtggtcgtggcgtcgtgggagtcggtcacggtgcgcgtcgcgcagtactacgcgtcgttcctgatcctgtcggggctgatggtcggcgtgttcgtcgcacaggacgggctgctgttcttcatcttcttcgaggcgacgctgatcccgctttacctgctgatcggcacatggggcgcgagcgccgcgtgtacgcggccgtgaagttcttcttcatctcgttcgccggctcgctgttgctgctgatggcgatgctgtacctgtacgcgcagtcgcacacgttcgacatggccgtgtggcgcacgctgcagctcggcttcgcgccgcagttgctggtattcctcggcttcttcgccgccttcgcggtcaaggtgccgatgtggccggtccacacgtggctgagcgacgtctataccgacggcccgacgggcgcggcgctgatgctcgcgatgctcaagctcggcggctacggcttcctgcgcttcgcgctgccggtgacacccgacgcgagccacttcttcgcgccggccgtgatcgcgctgtcgctgttcgcgatcgtctatgcgagcctgatcgcgctcgcccagaccgatctcggcaagctgctcgcgtattcgacggtcgcgcacatggggatcgtcacgctcgggctgttcctgttcaaccggatcggcgtcgaaggcgcgatcgtgcagctcgtgtcgtacggcttcgtcgcgggcgcgatgctcttgtgcgtgaacgtgctcgtcgaccgcacgaagcagcgcgagattgcctcgtacggcggcgtcgcgggcgtgatgccgcgtttcgcgaccttcacggtgctgttcgcgatggccaacgtcggcctgccgggcacgtcgggcttcgtcggcgagttcatggtcatcatgggcgcgatccgcttcaacttctggatcggcgcgatcgcggcactgacgctgatcctcagcgcgtcgtacacgctgtggatgctcaagcgcgtcgtgttcggcaaggtcgcgagccagcggatcgcgaagctcgccgacctgaaccgtcgcgagatcgtgatgttcgcgtcgctcgccctggtcgtgctggcggtcggcatcgatccgaagccgttcaccgacgcgatcgatccgaccgtcggaaggctgatcgaagacgcgagccattcgaagctgccggcaggggacggccccgcgcagccgcagccgtcgtacatggcatcgacgcacggctgatcgcggcacgtcgcgcgaacggggctcaccgcgcggcggtgcggccgttgcgtacacatcgatcgcggtccggcgcaggtagcgccgggcccgcttgcggctgcgtgaaattgccccgcgacaatgtgtctcacaacagattctgcaatgatgattttccgcattagctggttcttcatcgcactcgcgcgacgtatgattcggccactttcgtggatcgaatgcgcatcgggcatacgcaaacggattcaatgaccctcgggcggtgtgatgaaaagaagagcttcaaaaggcggggtggcgctgatgtcgatcggcgcggccctgagcctgtcaggctgtaatttagatgtactaaatccgaaaggaagcgtgggtgctgccgaaaaggcgctgatcgcgacgtccacctgggcgatgctggtcgtcgtcgtgccggtgatcctgctcacgctgtggttcgcgtggcgataccgcgcgtcgaaccgcaatgccacctacgcgccgaactggtcgcactcgaccgcgatcgaggtcgtgatctggacggtgccgacgctgattatcctgttcctcggcgtgctcacgtggaagaccacgcacgagctcgacccgtacaagccgctcgagtcgtcggtgaagccgatcgacgtcgaggtcgtcgcgctcgactggaagtggctgttcatctatccggaactcggcatcgcgtcggtgaaccagctcgcgattccggtcggcacgccggtgaacttccgcatcacgtcggattcggtgatgaactcgttcttcatcccgcagctcggcggccaggtctacgcgatggccggcatgcagacgcgcctgcacctgatcgcagacgagcccggcaactacgcgggcacgtccgccaacttcagcggccgcggcttctccgacatgaagttccgcacgctcgccgagccgcgcgaacagttcgatgcatgggtgcagaaggtgaaggcctcgcccgaccgtctcgacgcgaccgtgtacggtaccgtcgcccagccgagcgagaaggcgccggtgcgctacttctcgtcggtcgatccgcggctcttccacaacatcatcgcgaaatacaacgatggccacgtcctcgacctgaaggacgccgcctgcggcacgaaggggtaacgcatgttcggcaaactcacactttcggcgatcccgttcgatcagcccatcatcatgggggcaggcgccttcatggggctggtcgtgctgggcattctcgccgcgctgacgatcaccggccggtggaaatggctgtggacggaatggctgaccacggtcgaccacaagagactcggcgtgatgtacatcatcgtcgcgctgatcatgctgctgcgcggcttcgccgacgcgatcatgatgcgcatgcagctcgcgctctcgtacaacgggcccggctacctgccgccgcaccactatgaccaggtcttcacggcacacggcgtgatcatgatcttcttcatggcgatggtgttcatggtcggcctgatgaacctggtcgtgccgctgcagatcggcgcgcgcgacgtcgcattcccgttcatcaactcgctctccttctggatgacggccgtcagtgcgatcctgatcaacgtatcgctcgtgatcggcgaattcgcgcagacgggctggctcgcgtatccgccgctgtcggagctgcagttcagtccggggtaggggtcgactactacctgtgggcgctgcagatatcgggcgtcggcacgctgctgaccggcgtgaacttcttcgtgacgatcatcaagatgcgcgcgccgggcatgacgctgatgaagatgccggtgttcacgtggaccgcgctctgcacgaacgtgctgatcatggcgtcgttcccgatcctgaccgcgacgctcgcgctgctcggcctcgaccgttacctcggcatgcacttcttcacgaacgaagccggcggcaacgcgatgctgtacctgaacctgatctgggcgtggggccatccggaggtgtacatcctgatcctgccggcgttcgggatcttctcggaagtcatcgcgacgttcgcgaagaagccgctgttcggctacaagacgatggtgtacgcgacctgcgcgatcatggtgctgtcgttcctcgtgtggctgcaccacttcttcacgatgggctcgggtgcgaacgtgaacgcgttcttcggcatcatgacgatgatcatcgcgatcccgaccggcgtgaaggtgttcaactggctgttcacgatgtatcgcggccggatcgaattcacgacgcccgtgctgtggacgatcggcttcatggtcacgttcacgatcggcggcatgaccggcgtgatgatggcgattccgggtgcggacttcgtgctgcacaacagcctgttcctgatcgcgcacttccacaacgtgatcatcggcggcgtgctgttcggttatctcgcgggcttcaactactggttcccgaaggcgttcggcttcaagctgaacgagaagctcggcaaggctgcgttctggttctggcaggtcggcttctacgtcgcgttcgtgccgctctacgtgctcggcttcatgggcatgacgcgccggctcaaccactacgacaacccggcctggcatccgtggctgctggtcgccgcattcggcgccgtgctgatcgcggtcggcattgcgtgccagttgctgcaactggtggtcagcatccgcaaccgcaacctgccggcataccgcgacacgacgggcgatccgtggggcggccgcacgctggagtgggcgacctcgtcgccgccggccgactacaacttcgcggtgatcccgcaggtgcgcacgctcgacgcgtatgcggacatgaaggcacgcggcgaaggccggccgaacccggcgtcgttccgcgacatccacatgccgtcgaatacctgcgcgggcctcgtggtggcgatcttcagcctggtgctcggcttcgcgctggtgtggcacatctggtggatggcgatcggcgggctcgtcgggatcgtcgcgacgctcgtgatctacagctcgcgcgataacgacggttattacatccctgcgtcgacggtgcgcaagaccgaagacaagcagccgacgcagcgcgtggccgcgcgcgtcgacgacgtggaactggaggccaactgatgttgcagaaaaccttgagcgcgaccctgctcgagcacgacgaccatccgccgtcgcattcggtgttcgggttctggctgtacctgatgaccgactgcgtgatctttgccgcgctgttcgcgacgttcgcggtgctcggccagcagtatgcgggcgggccgaccgcgaaagacctgttcgacattccgggcgtcgcggtggaaaccgccgcgctgctgctgtcgagcatcacgtacggtttcgcgatgctcgccgcgtacaagcagcggcgggcgcgctgctcgcatggctcgcggtgacgttcgtgctcggtgcggcgtttctcgtgatggaactgcgcgagttctcgcacctgatcgcggaaggcgcgggcccgcaacgcagcgcgttcctgtcggcgttcttcacgctggtcggcacgcacgggctgcacgtgacggccgggctgctgtggatgatcgtgctcgccgggcagatcgtgtttcgcggcggcgacctgaccgatcgcgacctgcgacgcctgacgtgcctgagcctcttctggcacttcctcgacatcgtgtggatctgcgtgttttcctttgtttatctcgcgagcgtgatctaaatggcccattcgcattcgtctcaactcgaagaagggcacggcagtgtcggcggctatgtcgccggcttcatcctgtcggtgctgctcacggccgcgtcgttcggcctcgtgatgggcggcgtgctgtcgccgcacgcgtcgctgatcgcgcttgccgtgctcgcgttcgtgcagatcgtcgtgcacctcgtgtacttcctgcacatgaacggctcgtcgggccagcgctggaacgtgatggcgttcagctacacggtgctgaccgcggcgatcctgatcgtcggcacgctgtgggtgatgcacaacgtcagcatgaacatgatgtcgcgctgagcggcatcgcggcgcgatgcgtcgaccggagaagcggcacgaaggtgccgctttttcgtccgcgagaagggcgctgcggcccgcgagggcggtaccgggggcatcgactgtatgattcggcgcgtccgcactgccggtgcgaacgccgatcggcaaaggcggaagggagcctgggcgcctccgacgggccgtcgattgttacaagacgttagcgcaagcttgcccttgcgatgccgcgcatcagttcttacaaacttgaaatatgcggtggcaacgcttgccgttatagtcgaatcacacatcaaacaacccccaaagaggaatccatgaagaccttgcgtattgcctcgctcttgaccggtatgacggccttgctcgtgtcgggcgcagcaatggcgggagtcaatgtcgggatcaatctcggcgttccggcaccggtctacgtcgcgcccgcacctgtgtatgcgccgccgcctccgccgccggtcgtctatcagcctgcgccggtctatgcgccggcacccgtctacgcaccggcgcccgctatcgtgatcggctggcatggcgaccgctactgggacggccgtcgctactggggtcgcgacgagtggtaccaccgtcacggcggccgccccggctgggatcgcggtcacggccattgggacaacggtcgccacaacggctggcgttgatcggcagggcgcacgcgtgatgtgcgcgcaacgttcgctgatgaggaaaccgcctgcatggcggttttcttttggcccgacggattgaatgggtagaatcgtccctcgttactaccctcattcgaccgacagggcctctatgacgaagggttcgccccgggccgccgcgcgtgtccgccgtgccgtacgggttgccggccgcacggccgcggtgttcgtgttgcaggcggcgctggccgcgaccgccgcgcacgcggcctacgccattgcgcagtacggcgagccgaagtatccgccgggcttcaggcatttcgactacgtcaaccccgacgcgccgaagggcggcacgctcgtgctcgcgaacccgaaccggctgacctcgttcgacaagttcaacccgtttacgatgcgcggcaatcccgcgccgggcatcgacatgctgttcgagagcctcgcgaccggcagctcggacgagcccgcgtccgcgtacgggctgctcgccgacgacatcgacatcgcaccggatcgccgttcggtcacgttccacctgaatccgcgcgcgcttttccaatggcgacccggtcacggccaacgacgtcaagttctcgttcgacacgctgaagagcaagctcgccgcgccgcagttcggcgcgtatttcgcggaaatcacgaaggccgtggtggttgatcctgccaccgtacgtttcgagttccgcagcgcgaatcgcgaactgccgctgatcgccggcggcgtgccggtgttttcgcgcaagtggggattgcgcgcggacggctcgcgcatcccgttcgaccagctcgcgttcgagcagccgatcggcagcggcccgtacctgatcgagcgctacgacaacggcaggacgatcacttaccggcgcaacccggcgtactgggggccgacctgccggtgcgggtgggcaccaacaacttcgaacggatcgtctacaagctgtacggcgatggcgttgcgcggctcgaagcgttcaaggccggcgaatacgatgtgctcgtcgagtacatcgcgcgcaactggacgcgccgcgacgtcggcaagcgtttcgacagcggagagctcgtcaagcgcgaattccgccagcacaacggcgccggcatgcagggcttcttcatgaacctgcgccggccgctgtttcgcgacgtgcgcgtgcgccaggcgctcgaccttgcgttcgacttcgaatggctgaaccgccagctgttctacagcgcctacacgcgtctggacagctacttcgccgacaccgacctgcaggcgaccggcacgcccggccccggcgagctgaagttgctggagccgctgcgcgcgcagctcgatccggccgtgttcgggccgatggtcacgcagccggacacgaatccgccgggctcgctgcgcgcgaacctgctgaaggcgcgcacgctgctcgcgcaggccggctggacctatcgcgacggcgcgctgcgcaatgcgaagggcgagccgttcacgttcgagatcctcgacgattcgggtgccgcgatggaaggtgtcgtgacggcctatcagcgcaatctggcgaagctcggcatcgatgcacgctttcgcacggccgatttcgcgctgctgcaaaagcgcctcgacgcgttcgactacgacatgacgacgatccgcctgccgggcgtgcaggtgccgggtgccgagcaatactcgcgctacgccagcaagttcgccgacgagccgggctccgacaacctcatcgggctgaagtcgccggccgtcgacacgctgctgcacgcactcggcaccgcgcagtcgcgcgacgaattgctcgacgcgacgcacgcgctcgaccgcgtgctgatgcatggctactacgcggtcccgcagtggtacagcacgacgcaccggatcgcgtacaagcgcacgcttggctacccgcagacgctgccgctgtactattcggccgagggctgggtcgtgtcgacctggtgggcgaagcccgatcactgagccacgccgccctacgtccaaccccgcctaccgatcgcgagtcgacgcccatgtggagctacatcctcaaacgcctgctgctgatgatcccgacgctcgtcggcgtgctgacgcttacgttcgcggtgatccagttcgtgccgggcggccccgtcgaacaggccgtgcaggaattgcgcaagggcgcgacggagcagggcgcggtgccgttcgggatgcgcgcacacaccggcgtcgacgcacagcagctcgcgcagctcaaggcgctgtacggtttcgacaaaccgccgctcgaacgctactggctgatgctgaagcgcttcgcgcgcttcgatctcggcgacagctacttccgccaccagagcgtgtggtcgctggtcgtgcagaagctgcccgtgtcgatcagcatcgggctgtggacgttcttcctgacgtacctgatcgcggtgccgctcggcatcgcgaaggccgtgcgcaacggttcgccgttcgacgtcgcgacgagcctcgtcgtgctcgtcggttatgcgattccgggcttcgtgctcggcgtgctgctgctcgtgctgttcggcggcggctcgttctggcagcttttccgctgcgcgggctcacgtcggacaacttcgcccagctgtcgttcgtcggcaaggtgctcgactacctgtggcacatcgcgctgccgatcacggcgtcggtcgtcggcagcttcgcggtcgtcacgatgctcacgaagaatgcgtttctcgaccagatccgccggcaatacgtgctgaccgcgcgtgcgaaggggctctccgagcgcagcgtgctgtggaagcacgtgttccgcaacgcgatgctgccgctgatcgtcggtttcccggccgcgttcatcggcgcgttcttcacgggcagcctgctgatcgagacgctgttctcgctcgacggactcgggttgctgtcgtacgaatcggtcgtgcggcgcgactatccggtcgtgctcggcacgctgtacctgttcacgctgatcggccttgcgaccaagctgatctccgatctctgctatgtgtgggtcgatccgcgcattcaattcgacaccctggagcgctgacatgaaaccgtccgtctgcatgcccggcgtcaccgggcgaggtgcgcgatgaaccgggccgtcgtgtcgtcccgcatcgacgcggcgcgcgcccgcgtgtcgccgtctcccgcgcgccgcgtatggcagcgcttcaggcagcagcgcctcggctactggagcttcgtgatcttcgtcgtcgcgttcgccgcgagcctcgcggcgccgctgtggtcgaacgacaagccgctcgtcgtgcgttacgacggccagacctatttcccgatgttccatgcgtatccggagacgaccttcggcggcgatttcccgacgccggccgactatctcgatccgtatgtgcgcaagcggctcgaggcgcccggcaacttcgtcgtctacccgccgaaccgttattactacgacacgctgaactatttctcgaacgtgccgaaccccgcgccgccgtcgcgcgcgaactggctcggtaccgacgcgcagggcgcgacctgctcgcccggctcgtgtacgggttccgcgtgtcggtcgagttcgggctgatcctgaccgtgatcggcacgctgctcgggatcgccgcgggcgccgtgcagggcttcttcggcgggcgcatcgacatcgtcgggcagcgcctgatcgagatctggagttcgttgcccgagctgtacctgctgatcatcttcgcgtcgatcttcgagccgagtttcctgctgctgatcgtgctgctgtcgctgttcggctggatcgggctcgccgactacgtgcgcgcggaattcctgcgcaaccgcacgcaggactacgtgcgcgcggcgcgcgcgatggggctcacgaactggcagatcatctggcgccatgtgctgccgaacagtctcacgccggtgatcacgttcctgccgttccggatgagcggctcgattctcgcgctcacgagcctcgatttcctcgggctcggcgtgccgccgccgactccgagcctcggcgaactgctcgcgcagggcaagggcaacctcgacgcatggtggatctcgttgtcgaccttcggcgtgctggtcacgacgctgctgctgctgaccttcatgggcgacgcgctgcgcaacgcgctcgatacgcggatcgccgattcggtgcgcgcggcgggaggccagcgatgagcgaaccggtcgtatcgacgcagcatgagtcgctgctggcgctcgagcatctgcatgtgcgcttcggcgacacggtcgcggtggacgacgtgacgctcgagatcggtcgcggcgagcgcgtcgcgctggtcggcgaatcgggttccggcaagagcgtgaccgcgctgtcgatcctgcggctgctgcgcgacgccgacgtgagcggcgcgatccgcttcgcggggcaggatctggctggcaagagcgagcgcgagatgcgcgggctgcgcggctcggatatcgcgatgatcttccaggaaccgatgacggcgctcaacccgctgtatacgatcggcgtgcagatcggcgagacgatcgtgctgcacgacggcgtatcggcggtcgaggcgcgcaagcgtgcgatcgctctgctcgcgcgcacgggcatcgcggagccggagaagcgtgtcgacagctatccgcaccagttgtcgggcggccagcggcagcgcgcgatgatcgcgatggcgctcgcctgccggccgcgcctgctgctggccgacgagccgaccaccgcgctcgacgtgacgatccgcgcgcagatcgtcgacctgctgctggaactgcagcgcgaggaagcggaaaagcgcgggatggcgatcctgctgatcacgcacgacctgaatctcgtgcggcacttcgcggaccgcgtcgcggtgatggagcacggccggctcgtcgagagcgggccggtcgagcggatcttcgcggaacccgagcatccgtatacgcagcggctgctgaacagccgtccgcaacgcgcggtcgcgccggtgatgccgatcgcgcccgtcgtgctcgacgcccgtcacgtgagcgtgcagttcgcgcgcaagcggccgggcatcgcgggctggttcggctcggtacccgtgacggccgtcgcggatgtgtcggtgtcggtgcggcagggcgagacgctcggcatcgtcggtgaatcgggatccgggaagtcgacgctcgcgatggcgctgctcggcctgcaaaagacggccggcggcacgatcgaattccaggggcgcgcgctgtcgacctatcgcggccgcgaacagaccgcactgcgctcgaacatgcaggtggtctttcaggatccgttcagttcgctttctccgcgtcacacgatcgagcggatcgtcggcgagggctcgaactgcatcgcccggacatgacgcccgatgcgcgtcgcgcgaagtcgctcgcggtactgcgcgaagtcggcctcgaccgcacggtgctgcaccgttatccgcacgaattctcgggcgggcagcgccagcggatcgcgatcgcgcgcgcgctggtgctggaaccgcgcatcctgattctcgacgagccgacgtccgcgctcgacgtgtcgatccagcagcaggtgctcaagctgctcgcgaatttgcaacagaaatacaacctcggctatgtattcatcagccatgacctggaggtgatcggggcgatggcgcatcgcgtcgcggtgatgcagggcggggccgtcgtcgagtcgggcgaggtggccgacatcttcaccaggccgtcacatccttacacacaaaagctgttgaaagcggtctggaaagcgtgataggtcgccaatggtctgatcatctcgattgtatttattaatttgttttgacaaacgattacgcgctggctagtatcgaccgaaattttccgccaatcagctgatttttaagcaaattccatcgaccaatgcagcatcgatccctgacccaggcatgcgcgcgcaccatcgccgggctattcatcggcgccctgttcgcagcagcacccggcgcgttcgccgacgaagtcagcagttttaaccagaatgtcacaaattcgacgcagaacgcgtcgaattcctccctccagcaggccagcgcgcagccgtcgggcggcggcgcgaagtcgttcctcgccggcatggccggcaaggcaggcgacgtggtcgtcggcgcgctgaacatgatcggtgtgcgctatcgctggggcggcaactcgccggattcgggcctcgactgcagcggcttcgtgcgctacgtgttccaggacaccctcggcatgtcgctgccgcgtcgtgcggaagagatgagccgcgtcggcgagaaggtgagcatgagcaacctcaagccgggcgatctcgtgttcttcaacacgatgcgccgcacgttctcgcacgtcggcatctacatcggcgacaacaagttcgtgcactcgccgtcgacgggcagcaccatccgcgttgacgatctcgatagcggctactgggaaaagcgtttcaccggcgcgcgccggcttgagtcggagttcccgatgaagccggaagatctgcgtcagcgcgtgcgcgcgacgattggcgacgattcggcgaacggcaacaactgacgttcgacggccagtccggccggatcgaaaaaccctgtcaccgaaaggcggcagggtttttgttttggggcggtgcaaacgctgagacggtcgcgccgtcgtttgagggccggcggcgcgcgccggcctgctcatcgcgtgcttacgcggcggccacgccgcgcgctgccgcgagcttgcgctgcagttccggcatgatgcgcgcgacggcttcctcgcctgcaagaatggccgcgttgcgctggttgaagtcgctgccgcccatggccgcgaggttcgggcggatcacgacgtcggcgtacttgtcgagctcgtaggtcttgatcgtctggcccatgatcgtgaaggtctgcagcagcatctcgatcgggttgttggttgccgcgccgtccggccgggccgagatgtcgaccgcgatcacgaagctcgcgcccatcttgcgcgcgtacgacgccggcacggggctcacgaggccgccgtcgacatattcgcggttgccgatcttcaccggttcgaacaccgacggcacgctgcacgatgcgcgcaccgcgagccccgtgttgccctgctggaacaggatcggctgaccgctctgcagatcggtcgcgacaataccgagcggcttcgccatcttctcgatcggccggttgttgagcgtcttgttcaggaagttctgcagcgccacgccttgcagcagcccgcgcgaacggaacggcagcgcccagtcgctgatcgctgcctgatccatgtcgagcgcgatcttgttgatctgcagtgcgctcatgccggacgcatacagtgcgccgaccaccgagcccgcgctcgtgcccgcgacgatttcgaccgggatgccgcgcgcctcgagcgccttcagcacgccgatgtgcgagaagccgcgcgcggcgccgccgccgagcgcgatgccgatcttcaccggcttctcgcgcggctgcgtggcgccggaagtattgtccgaacgggatttgtcgccgaacgacgtgcaggcggcgaggctggcggacgcggcggcgatcgtgaagtggcggcgcgacaggcgagggacgacatcgagtggttctccggcggcttggcggcgggttacacggcccgcggcggcgataggttccgagcggccgcgcggcaggttccgtgcggccggtgccgcgccggctggcggccgcggcgcgcacatcataaagcaagcggcgcgcttggcgcgatgtccggcgcgagtataattccggcttctttcccgttccgggcgcggccggcccgttgctgtccgggctgccgccgtcgatcccgcgtcgaatcattcatgcgccccaggcgttcgagttaccgtttatgacccgtcctgtccgtacccgcttcgcgccgagtcccaccggcttcatccacctcggcaacatccgctccgcgctctatccgtgggcgttcgcccgcaagatgaagggcacgttcgtgctgcgcatcgaggacaccgacgtcgaacgctcgtcgcaggaagcggtcgacgcgatcctcgaagggatgcaatggctcggcctggatttcgacgaaggcccgatctaccagatgcagcggatggaccgctatcgcgaggtgctcgcgcagatgctggagaaggggcttgcatacccgtgctacatgtcggccgaggaactcgacgcgctgcgcgaacgccagcgcgaggccggcctgaagccgcgctacgacggcacgtggcgtccggagcccggcaaggtgctgccggagccgccggccggcgtaaagccggtgctgcgtttccgcaatccgctgacgggcacggtcgtgtgggatgacgcggtgaaggggcgcgtcgagatttcgaacgaggaactcgacgacctcgtgatcgcgcgtccggacggcacgccgatctacaacttctgcgtggtggtggacgacatggacatgggcatcacgcacgtgatccgtggcgacgaccacgtgaacaacacgccgcgccagatcaacatcctgaatgcgctcggcggcgaggcgccggtctacgcgcacctgccgaccgtgctgaacgagcagggcgagaagatgagcaagcggcatggcgcgatgagcgtgatggcgtatcgcgacgcgggtttcctgcccgaagcggtcgtcaactatctcgcgcgcctcggctggtcgcacggcgatgccgagatcttctcgcgcgagcagttcgtcgaatggttcgatctcgagcatctcggcaagtcgcccgcgcagtacgaccacagcaagctgagctggctgaacgcgcattacatcaaggaagcggacaacgcgcgcctcgccgagctggccaaaccgttcctcgctgcactcggcgtcgacgatgcggcgatcgccacgggcccggcgctcgatgccgtggtcgggctgatgaaggatcgcgcgacgacggtcaaggagatcgcggaaggcgcagcgatgttctaccgtgtgccggcaccggatgccgatgcgcttgcgcagcacgtgaccgatgcggtgcgtccggcgctggccgatctcgtcgctgcgctgaaggcggccgactggacgaaggaggccgtatccgccgcgctgaaggcgacgctcggcacgcacaagctgaagatgccgcaactcgcgatgccggtacgcctgctggtggcggggacgacgcatacgccgtcgatcgacgcggtgctcgtcctgttcggtcgcgatgtcgtggtgtcgcgtatcgaggccacgctggcctgagattcgggagcgagcgaagctgcccgtgcgtgacatcgcggcagcttcgcaaaaatttcgctccaatcgcaaaagggtatttacaagttcaaagtagctccatataatctcatttctgttctgcaaggggtatagctcagctgggagagcgcttgcatggcatgcaagaggtcagcggttcgatcccgcttacctccaccatcagaacaagctggattgatttgcgaagcagcagtggtagtaataaatgcttcacaaaatgattcaaagcagttagaatttcggccttcgctgttgattgaaaagtgaatagcgaaagtcagacagatctgaaaagattttgtccccttcgtctagaggcctaggacatcaccctttcacggtgagtacaggggttcgaatccctaggggacgccaggattcagcggcgtttcgtagaagtgtcgcaaggctcgcaggaacgtaaccgacgtcctgcgggttgggtaagaaagctggagcggtagttcagtcggttagaataccggcctgtcacgccggggtcgcgggttcgagtcccgtccgctccgccagaacgaagcccgttcaagacgtttttgagcgggcttttgtattaaagatgtaagcagtacgttgtccccttcgtctagaggcctaggacatcaccctttcacggtgagtacaggggttcgaatccctaggggacgccaggattcagcggcgtttcgtagaagtgccgcatcgcttgcaggagcgtgacaagatcctgcgggcgaaggtaagaaagctggagcggtagttcagttggttagaataccggcctgtcacgccggggtcgcgggttcgagccccgtccgctccgccagaacgaagcccgttcaaagaacgtttttgaacgggcttttgtattaaagatgtaagcagtacgttgtccccttcgtctagaggcctaggacatcaccctttcacggtgagtacaggggttcgaatccctaggggacgccagatttcggcgtcgttcgaacaaacgatgcgccggcaggaagcaaccgacgcctgccaggcaagcagcaagactggagcggtagttcagtcggttagaataccggcctgtcacgccggggtcgcgggttcgagtcccgtccgctccgccaaaaatgaagaagcccgcctcgtgcgggctttttattgcgtttccggttgcgcccgccggcgggcgcgtgactgcggagcggaggaagctgcctgcacggttttcggcggggcgcgcagggatgcgcgtgcgcaaggggatgcagacgagtcccgcccgcctgcctgaaaatgaagagcccgcctcgcgcgggcttttgcatgtgtggcgccggttgtgtccgcaggcgggacgtaaccacaggtcatcacgcgtcgagccgctacgagaaatccgcgattgcatccgcacgcgactgcgctatcgtggcgggatgcgttcttgacccctgcgcgatgctcgatccgaccgacctgcgactcctgtatcagctccggcctgcggaggccggcgattttccctttgccgaagcgctgacgcacggcaacatgggcggctattacaagcgccatgggctcgtgtggcgcagcgacctgttctacgcgagctggcgcgaatccgagaacttcatcctcgaggccgacggcgagcgcatcggcgtgctgcgcgtgaccgaggagggcgactcgctgcacatccgcgacgtacagatcgcggccggtcatcgcgggcagggcgccggcacctacatgctcgacatgtcgcaccgctgggcgcgtgcgcgcgggctgcacgaacttcaattgcgcgtgttcgtcgacaatcctgccgcgcgtctttatttgcgcatgggctatcaggttgccgggtcgcggctcgcgcaacttggctcgatccgccacatggtgcggccggtctgacgcgctgacgactccgaatgacgcgttcagcggacagcgccgatggcgtcgtcgtccggggtttcgtcgtccgcgaggctgccttccgggccgcggtgttcgtagccgcgcagcatgaatgcgcggggctttcgccgaatgcgcgccggaacatcgccgaaaaggcgctctggctctggtagccgagctcgcgcgcgatatgcgacagcgggcgcccctggttcagcagcggaatggcccgtgccagcagtgcctgctgacgccactgcgaaaaactcacgcccagttcctgcttgaagagccgcgaaatcgtgcgcgtgctcgcgccgacctcgcttgcccagtgctcgagcgactccgcatgcgccggatgcgcgagtaccgattcgcacagcatgcgcagccgttttcgtcgggcatcggcaccgcgagcggcagcggttcggcgcgactcagctcgtcgagcacgagcccgcacagcaggcgctcgcgcgcggtgctcaggtcgcgcgcgtcgagcgcgacgatcagttcgcgcaggagccccgtcacttcgacgacgcggcacgcgtcaagcccttccggcacgatcgactcgtcgatgtacagcgtgcgcaagaacgcctcttcgacgatcacgacttcgtgcgtcacgtgcggcggtacccagatcgcacgggacggcggcaccatccatgtcgtgccggtcgtcgcgacgcgcagcacgccgcgcgatgcgtacgcgagctgtgcccatgcatgcgtatgcagcgggatgcggcgtccggcgtcgagctgccgtgcgcgcacgcgcatcggatggacggcggtcggcgcgaattcgggcggaatgtcgatgacgtacaggttcggtacgtcggcttgggcgggcggattcatggacgattcgggcaacgctgcggcgatgccgttattgtagaaggcgccgcgaaagcgcatgcgacggtttgtcgggcgatcatgccgcgctcaaatgaactttgtgtgggagcgccggagatttcagggccgcccgaaaccagacgcgctcgtgggcccgaaccatcgggccggtatcgtggtctatcgatgcgcgggtgattgcgcaagaattgcgcacggatcgcgcatgaatcgcccgtgaacacggcaacacacgaatcaaagaggagaaccacgatgcgttacgtattcgtctacggcaccttgagaaacgggaggccaacgacatcggccacgcagccgccaggcacggaattgccgcgccgacgctgctcggcgccgcagcgctgccgggagagctgtacgatttcggcacttatccggggatggttgccggatcggccggcaagtcgctggtctggggtgacgtctacgaagtcgacgaccggctcgttcccgtgctcgacgagatcgagcgcgtctatccgggtgtcgacacgctgttcaagccggaagacgtgaccgtcgaactcggcggccggcagtacgcgtgcctttactatccggtcgccgcgcacgcgacagcggggcgtccgcgcattgcgtcgggcgactgggttcagcaccggcgcgagcggaagccgtctgaccggtcgcgcggcagccgcttcagccgcaaaggaaaaagcgccccgaggggcgctttcgtttgtgccgtcattcgcgtgcgaccggcgccgacgcaggggcggccccgatcgggacgggcggcttcgtcagatttcctcgtacagcggcagcgtcaggaattcggtgaagccttccgacgtcgacatctgctcgaagatcgcggcggcgcgctcgtacggctgcgtgttgccgccgaccgcgcgcttcacgttgtcgagctcggccttcgagaattcccgcacgagttcggccgtgaccttgcggccgtcgtcgagcacgcccttcggcgagcggatccattgccacacctgcgaacgggaaatctcggccgtggccgcatcttccatcaggttgtggatcggtacgcagccgttgccgtcgagccaggcgccgaggtaatggatgccgacgttgatgttgttgcgcaggccggcttcggtgatcggcgcttcgggctggaagtcgagcaggttcctgccttcgacctgcacgtcgtcgcgctgcttcgcgatctggttcggcttgtcgccgagcaccttgacgaactcttccatcgcgatcggcacgaggcccgggtgcgcgacccagccgccgtcgtagccgtcggtcgcgtcgcgctgcttgtccgaacgcacgccgcccatggccttgtcgttcgcttccggatcgttcttgatcgggatcagcgcgctcatccgccgatcgccggcgcgttgcgcttgtgacaggtcttcagcagcagcagcgcgtacgcgcgcatgaacggcaccgtcatcgtgatcttcgaacgctcggccaggcagaagtcgcggtcgttcttgaacttcttgatcgccgagaagatgtagtcccagcggcccgcgttcaggcccgagctgtgttcgcgcagttcgtacaggatctcgtccatctcgaacgcggcgaggatcgtctcgatcagcacggtcgcgcggatcgtgccgcgcggcacgccgacggcttcctgcgccgcgacgaagatgtcgttccacagccgtgcctcgagatggctttccatcttcggcaggtagaagtacgggcccgagccgcgcgcaagcagttccttcgcgttgtggaacaggaacagcgcgaaatcgaagatgccgccggacacgcgctggccgtcgaccgtcacgtgcttctcgtcgagatgccagccgcgcggacgcacgatcagcgtcgcgaccttgtcgttcaactggtaggacttgccgttctgctcgagcgagatcgtccggcgcaccgcgtccttcaggttgatctggccgtcgatctggttcgtccagctcggtgcgttcgaatcctcgaagtccgtcatgtacgaatcggcgcccgagttcagcgcgttgatgatcatcttgcgctcgacggggcccgtgatctcgacgcggcggcattgcaggtcggccggcagcggcgcgaccttccagtcgccttcgcggatcgccttcgtctcggccaggaagtcggggcgctcgcccgcgtccaggcgtttcgtgcgctcgacacgcgcctgcagcagcgcctggcggcgcggttcgaacgtgcggtgcagcgccgcgacgagtgcgagcgcgtccggcgtcaggattgcttcgtaacccggcttgatttcgccggtgatcgccatgccttgcggcagcgtgatcggggtgctcatgagtctcatctccttggtcggtcagttgcggtttcggtaaaggggaaggcggcagctgcaaacgtcatgcacccgggccggggcgcgtgcggtttgcgggtctgccggacggagccggggtggcgaggaatgcgagcaggtcggccatgccggtgcccgtaccgtccggcggcgcgccgagttcctcggcgggcgcgcccgtgcggttgagccagaacgtggtgtagccgaaccagacggcgccggcgacgtcccacgcattcgacgacacgaacacgatgccgcgccggttcggtccgaacgcggcggtgccgagcgcgtaggccgccggactcggcttgtacgcgcgcacggtatcggccgacagcacgcgatcgaacagcccggacatgccggcgctcttgatcgcgatgtcgagcatctgcggcgtgccgttcgacaggatcgcgagcggcgggcgcgggtcgagcgcgcgcagcttgcgcagcgcgggcaccgtatcgggataggtggacaggcacgcgtattcgtccatcagtcgcttctcggccgcgctgttcagcgcgagcccgagtcggcgcgcggcgaaccgcagcgcatcgagcgtgatgtcccggaacgggcggtagcgggcgccggccggatccgcgagcgtgcgcagctgcgagtattcgatttgcttgcgtcgccacagctgcgacaaccgttccccgtgacccggaaacatctgctccgccgcggccagcaccgcacgcacgtcgaacaacgtgccgaatgcgtcgaagaggattgcgtcgggagaggagagtgtcgttgtggccgacatagccttgcgctccagtttcagaggtcgggtaaattctattcgtgatcgtatgcgctaaaaagacgctattcatcacttgatcttttactttcatatacctaatcttgagccgtttaagctatttgaagggcggcggcaccgcccggcgagtcatggaccggttcaagcagatcgaaacgttcgctgcggtcgcggcgaagggcagcctgtcggcggccgcgcatgcggaaggcgtcgccccggcgatcatcggccgacgcctcgacgcgctcgaggagcggctcggcgtcaagctgctggtgcgcacgacgcgcaagctcacgctgacgttcgagggctcggcgtttctcgaggattgccagcggatcatcaacgacatgcagaacgccgaggcgagcgtgtccgccggcggcgtcaaggcgagcggccacctgcgtatttccgcgccggccggcttcggccggcggcacgtcgcgccgctcgtgcccgaattcagcgtcgggcatcccgacgtatccgtcacgctcgacctgtccgaccgcatggtcgacctcgtcaacgaggggttcgattgcgcggtgcggctcggcgagctgcccgactcgtcgctcgtgtcgctgaagctcggcgagaaccgccgcgtgtgcgtcgcggctcccgcgtatctcgtacggcgcggcacgcccgcgacgctcgcggaactggcgcggcacaactgcctcgcgctcgcggcaaacgcgaaccagcagcgcggctgggcgttccaggaggacggcaaggtcgtgtcgatccgcgtgaacggcacgatggagtgctcggacggcgcggtgctgcacgagtggtgcctcgccggacatggactggcgtggcgctcgtggtgggaggtcggcgaggacatcgcggccggccggctcgtcagcgtgctcgacgcatttgccgccccgccgatcggcatccacgcggtgttcccgcaacgcaggcacctgccgctgcgtgtgcggctgtttctcgactacctgaagcacacttacgagcggcccggatattggggcgagtagcagcgggagccggtcgcgttcgcccgcgtgtttccgatatgagggcgaacccgctgccggggccggttgggcggtttcgcgcactacactcgtaggaggcatgtccgacgcgccacggccgccccggatgggatcgcggcttgcggcgtgtacttgacgaaggagggcgcgatgttccggcacatcctcgttccaaccgacggttccgaactgtcgcagaaggcgatcgacggcgcgatcgacctggcccgggcggtcggtgcgcgcgtcacggcgtacgcgtgcctgccgcagtatccgtactcgccgttttccgaagtgatcatcgagccgcccgccgatttccgggcgcgcagcgagcgcgaggcgcgcacgcatctcgacgaggtcgaatcggccgcgaaggcggccggcgtcgactgcgacacctggacgagcgtccatccgtcgccgtatctcggcatcatcgaggcggcagaacgcggcggttgcgacgtgatcttcatggcgtcccacggacgccgcgggctcggcagcttgctgatcggcagcgagacgcagcgtgtgctgacccatacgaaaattccggtgatcgtctatcggtagggcggtgccctggaaaaagggcgcgccggacgaagccggcgcgcgtcgttgctggcggcacgcaggccgcgcggccggtcgcgcgatcggtatcgcgcgcctgccgtctcctccctgattcttgttcggtggccgatgccgcaccgtcgcgagacggggcgggcatcggcatgacgcgcctggcgcgtgttacgcgaccttcttgccgtcgaagaactgctcgtcctcggtcgagccgtgcagtgcggtcgtcgacgcttcgcgttcgaccgtctgcgtcacagcgtcgaagtagccggtgccgacttcgcgctggtgcttgacggccgtgaagcccttgtccgcggccgcgaactcggcctgctgcagttcgacgaaggcgctcatctgcgtgcgggcatagccgtgcgcgaggttgaacatcgagtagttcagcgcatggaagccggccagggtgatgaactggaacttgtagcccatcgcgccgagctccttctggaacttcgcgatcgtcgcgtcgtcgaggttcttcttccagttgaacgacggcgagcagttgtacgacagcagcttgcccgggaactgcttgtggatcgcctccgcgaacttcttcgcatactcgagatccggcttgccggtttcgcaccagaccaggtcggcgtacggcgcataggcaagaccgcgcgagatcgcctgcccgatgcccggcttcgtgcggaagaagccttccaccgtgcgctcgcccgtgaggaacggcttgtcgttgtcgtcgacgtcggacgtgatcaggtcggcggcttccgcgtcggtgcgggcgaccagcacggtcggcgtgcccatcacgtcggccgcgagacgcgctgccgacagcttcgcgacggcttcgcgggtcggcacgagcaccttgccgcccatgtggccgcacttcttcaccgacgcgagctggtcctcgaagtggacgcccgatgcgccggcttcgatcatcgccttcatcagctcgaacgcgttcagcacgccgccgaaaccggcttccgcgtcggcgacgatcggtgcgaagaagtcgacataaccttcgtcgcccggattcttgccctccgaccactggatctggtcggcgcgcgtcagcgtgttgttgatgcgcttcacgacgagcggcaccgagtttgccgggtacagcgactggtccgggtacatttcgcccgcgacgttcgcgtcgccggccacttgccagccggacaggtagatggccttcaggccggccttcacctgctgcatcgcctggttgccggtcagcgcgccgagtgcgttgacgaacggctcgttgttgacgaggctccacagcttttccgcgccgcgcttggcgagcgtgtgctcgatcggaaccgaaccgcgcaggcggaccacgtcctcagccgaatagctgcgcttgatgcctttccagcgcggatcggtttcccattgcttttgcagttcctgtgcctgttgctgacgcgacatgatgagctccttgatgcggtgcgatgcctgatgggttgaatctgacggtggtgaggctgttctcgaagccgggagcgttgcgttccggttcgtgaggtcttgtataagagtctaggcaaatcgaccgaggcgggacagggggctttgtggggcggcagtcaaatttttagttgttttgaatcagtggcttgaagttgtaatttcgagataagaaatgccttttcccatcccgcaatcgcccgggttgtgccacgcagcatgatttttacgacacaaaaaattttccgcatcgtgaaatgtggggcggggcgaaaaaaccggcgcagatgcgccggttggctgaatgggcagtgccatccgtggggcggccggtggccgcccgtgcgtgcttacgacgcggagttgctgcgacgcgggccgccgctgcgttgaccgtcgcggcgcgggccgccgtcacggctgccgcccggcttgccgctccagccgccgccattgccgccgccgtagctgcggccgttgccgccatgaccgccgcccggcttgccgccgaaacgtcgaccgccgccgttaccgccgcccggacggccgcggccgccggtgccgccgttgcgcggggtgccttgcgcggctcgaaaccttcgatcacgttgaccggcagcggcgagcgcacgaagcgttcgatgcgcttgagcgcgccctgttcggcgtggtgcacgaggctcaccgcggtgcccgaacggcccgcacggcccgtacggccgatacggtgcacgtagtcttccgcgaacttcggcaggtcgtagttgaacacgtgcgtgatgcccgggatgtcgatgccgcgcgccgcgacgtcggtcgcgaccagcacgcgcacacggcgttcgcgcagcgcacggatcgtgcggttacgcgcgccctgcggcaggtcgccgtgcagcgcggccgattcgaagcctgcgtcggcgagacggccggcgagctggtcggcatcgatcttggtcgccgtgaagatgatcgcctggtcgagcgcgtcgtcgcgcagcaggtgatcgagcaggcgatccttgtggtcgcggtcgtccacgtagtgcacggtctgcgcgatgttcgcgcgcgactcgaggcgctgctggatctcgatgcgctcgggatccttcagcaggcggctcgtcagcgaaccgatcttgccgtcgagcgtggccgagaacagcatcgtctgacgcgtcgcgggcgtcgcggcgacgatcgtttcgatgtcgtcgatgaagcccatgtcgagcatgcggtcggcttcgtcgagcacgagcatcttcagctcggacaggtcgatacggccgcgttcgaggtgatcgagcagacggcccggcgtggcgaccaggatttcgggattcttcgcgagcagcatcagctgctggccgtaggcgacgccgccgaggatgctgaccgtgcgcaggcgcttcaggtgcttgccgtaggtcgacgcggcggtggtgacctgcatcgcgagttcgcgggtcggcgtcagcacgagcaggcccgggcgcgcgacgggttgcgggcggcgcgcacggcggtcgccctggttcggttcacgcggcgcgcgcggctgttgcgcctgtgccttctggagctgcgcgaaacgttcgatcgcgggcagcatgaatgcagcggtcttgcccgaaccggtcgggctcgagaccagcaggtcacggccggcgatgccggccggaatcgcgcgctgctggaccggcgtcggcttcacatagccggcggcctgcagcgcggagacgatctccggcgacaacccgagcgacgcgaagctcggctcgtccgacgccggttcgaccgcggccggtgcggcggcgtcgtcgagaccgagcgcctggtcggcgatcgcgttgagcgggctggagttgatgctcgaagtcataacaatccttgaaacacagtgggtgaaacgtcggcgccaatcgcgcatacccaagtcgtcggattcagcgagcaaatcgggaaacgggtgcaatccgccgaaccgtcggcggatgaggcattagaagctgttttgggtgcggcgcgcttcaggagcgggccgccagcctgataagtgacgaccgcgaaggtcgaagcaggaggggacaggttctaaaccggattggagcttaacgctacgaggcgtcgggccggaacggcttgcgagccgagcgcggagatgacgcagccagcattataaagagatttgctgcgctgcgccactgatttgattgcctattgcgaccgggggcggccgaaggctattcggtcaggatgccgtgccgttcttcagcgattcgacgagttcgatgtactgctgctttgccgcatcctgcgacgtgcctttcagcgcatcccatgcgtcgtacttgtatttgccgacgatgtcggtgaagcccggcttgtcgccatgggcgtcgccgtcggtcgcctgcttgaagagcgcgtacaggcgcagcagggtcaggttgcccggccgttccgtcagttgcttgacgtcgatctgggcctggtcgaattgggcggcgagttcgctcatcgggtgtctccgtaagggtttcaggtcgggcgatcttaacaagcggaccgccgcgcggggtcgagcgatccttccaaaccgccgccgggcgtgcgggtgcgcacggatcgggcccgatcgcccgtgggagcggggtgccgcattacaatgtcgcccatgacgcaaacagtgctcctcgccatcgatacgtcgaccgaatactgctcggtcgcgctgctgcgctcggcccaggccgatgacgccgtttccatcccgcaaacctgggtccgccacgagctgacgggcgccgtgtcgagcacgcgcgtgctgccggcaattcaggcgctcttcgccgaatcggggctgacgctcgccgattgcgacgcgatcgcgttcggcgcgggcccaggctcgttcacgggcctgcgcaccgcgacgggcatcacccagggctcgcgttcgggcgcgggctgccggtcgtgccgatcggcacgctgctcgcgtgcgccgagcacgcgcggctgcgcgccccggtacgacccgcgtcctcgccgcgctggatgcgcggatggacgaagcctactgggcggacttcgcgtggaacgaaagcgccggcgactggctcacgctgcatccggcttcgctcgatgtaccgggtgcggtcggcgtgcccgatacgccgttcacgctcgcgggtaacgcggccgccgcgttcggcgcgcagttgccggccgcggcgcacgcggccgtgatcgacggcgacgcgatgccgcacgcgctggcggtcgcccatgccgcgctgcgcgcgttccgcgccggccgtgcggtgccggccgaccaggccgcaccggagtacgtgcgcgacaaggtggcacagacgaccgccgagcgcgtcgcggcacgcgccgctcaggcaggcggagcgaagggatgacgggcgtactgctgagcgaccgctacctggcgccgatgacggatgccgatctcgatgaggtcgtcgcgatcgagcacgtcgcgtacgagttcccgtggagccgcggcaacttcgaggattcgttgcgcaacggctacctgggcgtgtgcctgcggcacgtgacgggtgcgctcgtcggctattgcgtgctgatgcccgtggtcgacgagatgcacctgcttaatctgtgcgtcgcgccggccgcgcagcgcgcgggtgcgggccttgcgctgctgcgcgaggctgtgcgcatttcgcgcgcggagcggctcgacggcgtgctgctcgaggtgcggccgtccaatccgcgcgcgatccatctgtacgagcgcttcggcttcgtgacgatcggtcggcgcaagaattactacccggcgaagcaccacagccgggaagacgcgatcgtgatgcgtctgacgctgaacaaggatgaggggacgcgcatggcatgggctgaagcggcgctcgaggaaatgggcctcgcgcagatctgggtgcggcgcgggcagggcgcgaatgaaggcgcggacgcgggcgcggcagtcgaagcgcccgccgcggcgcaaacgggggcggagaacgccgcacctgccgtcgttgcgaccgagcgacctgcgcgcaccgcgcgtacgccggtgcaagacgaggtgacgccggcagtggcgcggagcgtcgatgttccgccggttcgcgagcctgccgccccggcgcaccgcgtcgacgacggcgatcgcgtgcccgcgcgcgccgcgccggtcgcatcgaccgacacgatgccgccgatggacgatgcgccgcctgccggagccgacgattttgcgtggttcgatgcggcgccgccgggcgatcccgcgccgacggccccattgcgacgcgccgaaaccccggttgcgacactcgactgggacgcgctggctgcgcgcgtggccgactgcacgctctgccggctgtgcgagaagcggaccaacaccgtgttcggggtcggcgaccgcgaagcggactggatgctgatcggcgaagcgccgggcgagaacgaggacaagcagggcgagccgttcgtcggccaggccggcaagctgctcgacaacatgctgcagtcgctgtcgctccagcgcggcgacaacgtgtacatcgcgaacgtgatcaagtgccggccgcccggcaaccgcaacccggagccggacgaggtcgcgcgctgcgagccttatctgcagcgtcaggtcgcgctcgtgaagccgaagctgatcgtcgcgctcggccgtttcgccgcgcagaccctgctgaagacggatgcgagcatcgcgtcgctgcgcggccgcgtgcatgcatacgagggcgtgccggtgatcgtgacctaccacccggcatacctgttgcgcagcctgcaggacaagtcgaaggcatgggccgacctgtgcctcgcacgcgacacgttccggcgcgcggaaggcgccgacgtgaacgggccggccgggcaatgacgacgggcgcggcgtgcgcattcgtcgacacgctgcatgacgccgcggttcgcgatctgggctggttgcttgccagcccgagcctcctcaccgcggtaccgggagcgccgcttgcgcgcccgtggccggatgcggccgggcagtcggccgtccacgcatggctcgccgcgctcgatgcgcagcctgggccgctgcatcgcgcgctcgacgggttccggcccacccggctcggccgctacgcggaatgcctgctcgagtatttcctgacgcacggcccgtcgctgcggctcgtcgcggccaatctcccgctgcgcagcaacggcaagacgctcggcgaagtcgattttctcgtcgacgcgccgggcggtcagcgcctgcattgggaactcgcggtgaagtgctatttgtgcgcgccggtacgcgacggtgcatcgcttgccgacttcgtcggccccaatctcgtcgaccggttcgaccgcaagcgcagccggctgctcgatcaccagttgcgcctcggcgaacacgacgggtttgcgcggctcggctacggcgcgccgtccgacgcgcagatgttcatcaagggctggttgttctatccgcacggcgagccgttgccgccggtgtccgccgaaatcgcgccggatcacccgcgcggattctggctgacgcacgcgcagtggccggcgtgggcggccgcgcagcccgccggcgccgcatggagtgtgttgccaaggctggcgtggctggcgccgcggcgtgccgccgccgataccggattcgagccggaaccgctggcggccgctctggaactgccgcccgtgttgacgacgcgcgaggcccccgcgctgatcggcattcatgaaaagggcggtgacggcacctggcgcgaacgggcgcgcgggttcgttgtgccggacgactggccggtgcgcgcgcaggcgttcgcggcgcaggatcactgacgccgcgtcagccggcgctcaccaccagcgatggaagtgatggacggggccgacgccgtggccgacgtcgaggtgcccgctcgcggcgatcgcgccggtcaggtaggtcttggcttcgcgcaccgcgctttcgaggtcgggctgttgcggaagcagcgcggcgatcgccgacgacagcgtgcagccggtgccgtgcgtgttgctgaccggtacgcgtgcaccgtcgagccgcacggtgcgcgccgcttcgacgagccagtcggggctcgcggacgcgtccggcaggtggccgcctttcatcagtacggcacgcgcgcccgtctgtagcagggcccggccttgccggaccatgtcgtcttccgtggtggcgggcacgtcgttcagcagcgcggccgcttcgggcaggttcggcgtcacgaccgtcgcgagcggcagcagcgcatcgcgcaacgcgtcgacggcgtcgggcgccagcagcgcgtgcgagctcttcgagatcatgaccgtgtcgagcacgacgaagcgtggcgcataacgccgcagcgcgtcggcgaccgcgtgcacgatcgccgcattcgcgagcatcccgatcttgaccgcatcgatgcggatgtcgctgaacaccgcgtcgagctgtgcggtcacgaacgccgcgtccggcgcatgcacgcccgtcacgccgcgggtgttctgggcggtcaacgcggtgatcgcgctggcgccgtaggcgcccagcgcggagaacgtcttcaggtcggcctggatgcctgcgccgccgcccgaatcggagccggcaatcgtcaggatgttgggtatcgggtgcgtcatcggggcaatgcgccggtttggagaccggcgccggcggacggaaacgggaagtgtagcgtcagtgtcgcgattcgccgatcagcgcgaccgagtcgaactggcgctggttcgcctggtggcggcgcatcacgagccacatcgtcaggcagacgaacgtgccgaacaggacgatcacgacgccgaccggtacgtcgagccacacgagcactgcatacaggcacagcatcacgagcaccgacaggttctcgttgaagttctgcaccgcgatcgagtggccggccgacagcagcacgtggccgcgatgctgcagcagcgcgttcatcggaacgacgaagtaaccggacagcgcgcccacgcacatcaggaagatgtacgcgatgatcaggtacacgggcatgcgcaggtggccgaaatgcacggcccagtgcggcgggaacaggtcgcgcgtgtagaacgccatcagcatcaccgcgatgcccatgacgatgccgacgggcaacacggtcagcgacttcttcaacgggatccgggccgcggcggcgattgcgccggccgcgacgccgaccgcgaccacggcctggaggatcgcgccttccgacagcgacatgccgagcgagacttcagcccacttcagcacgatgaactgcagcgtcgcacccgcaccccagaacagcgtcgtgaccgccagcgagatctggccgagcttgtcgcgccacagcaccatgaagcagtcggcgaaatcggtgaggagcttgaccgggccgcgttcctgcttcgggtagcgggcgccggtatcgggaatgcgcaggttgaacagcgcggcgaccacgtaaatcgccatgatgatcgccatcgccgcttcggcgggcgtgccgatccaggcgggggtatgcgcgatcacgtgcgacgcgatgtgcgggctgatcagcgcaccgccgagcacggtgccgaggatgatcgagctgacggtcgtgccttcgatccagccgttggcggcgaccagcctgtcggccggcagcagctcggtgagaatgccgtatttcgcgggcgagtaggctgccgcgccgaagccgacgatcccgtacgcgatcagcgggtgggcgccgaacagcatgatcatgcagccgaccaccttgatcgagttggtgatgaacatcacgcggcccttcgggcgcgaatccgcgaacgcaccgacatacgccgccagcaccacataggacaacacgaagaacagcttcaacagcggtgtcatccagttgggggcgtgaaggtctttcagcagggcgatggcggcgatgaggagcgcattgtcggccagcgacgagaaaaactgcgcggccatgatggtgtaaaaacctttttcatctgatgcgatgctttcgtcgctgcggcagggccgcgtaggccgcctggtatgcgatcggcttattccgttcgaaatgggttgtgcgcacggctttataacatgaaaatacgccaattcggactagcaagattccccgatcgttccgcaagttgtcggcttcagtgctcaaaaggcgcggtaagctgatgattcgcaagcgtctttacgtaaatttcccatgccgcgcccgatctccgccaccatccacaccgccgctctcgcgaacaatctctccgtcgtccgccgctttgccggcccgtccaaggtctgggcggtcgtcaaggcgaacgcgtacgggcacggtctcgcccgcgcgtttccgggcctgcgcggcaccgacggcttcggcctgctcgacctcgacgaggcagtcaagctgcgcgagctcggctgggccggcccgatcctgctgctggaggggttcttccgctcgaccgacatcgacgtgatcgaccgctacagcctgacgacgaccgtccacaacgacgagcagatgcggatgctggaaacggcgcggctgtcgaaacccgtcaacgtgcagctgaagatgaacagcgggatgaaccggctcggctacctgccggagaaataccgcgccgcgtgggagcgcgcccgcgcgtgccccggcatcggccagatcacgttgatgacccatttttcggatgcggacaacgagcgcggcgtcgccgagcagctcgcgacgttcgagcgcggcgcggaaaacatcgccggcgcgcgcagtctcgcgaactcggccgccgtgctgtggcatccggacacgcatttcgactgggtgcgcccggggatcgtgctgtacggcgcgtcgccgtcggggctgtcgtccgacatcgccgacacggggctgaagccggcgatgacgctcgcgtccgaactgatcgcggtgcagacgatcgcgaagggccaggcgatcggctacggctcgacgttttccgcgcaggcgccgatgcggatcggcgtggtcgcatgcggttatgcggacggttatccgcgggtcgcgcccgaaggcacgcccgtgatcgtcgacggcatccgcacgcggatcgtcggtcgcgtgtcgatggacatgattaccgtcgacctgaccccgtgcccgcaagccggcgtcggcgcgcgggtcgagctgtggggcaatgcattgccgatcgacgacgtcgcccgccattgcggcacgatcggttacgagctgatgtgtgcagtcgccggccgcgtgcccgtgcgcgcggaataagggcgtcgcgcgtggccaaacagaaaactgtatacgtctgcagcgagtgcggtggacagaccccgaagtggcaagggcaatgcccgtcgtgccaggcctggaatacgctcgtcgaatcggttcctgaaacgccgtcggcccatcgtttccagtcgctcgcgaagcgtgcgcccgtgcagcgtctcgtcgacatcgaagcagccgacgtgccgcgcttctccaccggcatcggcgaattcgaccgcgtgctcggcggcgggctcgtgccgggcggcgtcgtactgatcggcggcgatccgggtatcggcaaatcgacgctgctgctgcaatcgctcgcggacatcgcgagcgagcggcgtgcgctctatatcagcggcgaggaatcggccgcgcaaatcgcgttgcgcgcgcaacggcttgcgctgctcgacggcggtgcgccggcagacgaactgaagctgctcgccgagatccagctcgagaagatccaggccgcgatcgacacggaacggccggacgtggccgtgatcgactcgatccagaccgtctactcggaagcgctcacgtcggccccggctccgtcgcgcaggtgcgcgaatgcgcggcgcagctcacgcgcatcgcgaagcagtcgggcaccgcgatcattatggtcgggcacgtgacgaaggaaggcaatctggccggcccgcgcgtgctcgagcacatcgtcgacacggtcctgtacttcgaaggcgacacgcactcgtcgttccggctcgtgcgcgcgttcaagaaccgcttcggcgcggtcaacgaactcggtgtgttcgcgatgacggagcgcgggctgcgcggcgtcgcgaatccgtccgcactgttcctgtcgcagcacgagcaggtcgtgcccggctcgtgcgtgctcgttacacaggagggcacgcgtccgctgctcgtcgaagtccaggcgctcgtcgacaccgcgcacgtgccgaacccgcgccggctcgccgtcggcctcgaacagaaccggctcgcgatgctgctcgcggtgctgcaccgtcatgcgggcatcgcgtgcttcgaccaggacgtgttcctcaatgcggtgggcggcgtgaagatcaccgagccggccgccgacctcgcggtgctgctcgcgatccattcgtcgatgcgcaacaaggcgctgccgaaggggctgatcgtgttcggcgaagtggggctggcgggcgagatccggccgtcgccgcgcgggcaggagcggctgcgcgaggccgcgaagctcggtttcacgtccgcgttgatcccgaaggcgaacgcgccgaagcagccgatcgaagggctgaacgtgatggccgtcgatcggctcgagcaggcgatcgaccgcgtgcgcgatctcgagtgaccggctgcacgggcacgcgggccaggcctgccggcgatctggcgcgtaattcgttgtaaagaatatgtaggcttctgtaacccgccggacatcgcttttccctatcctttgccggattgtcgaaccgcgcaatgcgaagggaacctatgttgaaatcctatggggaagcgccgggcggacgcctttacaacctgcgcggctgccgcgtgtcggagccgattcgccaaccctggggcggtggatgccggatcgtcgaatggatcgacgaagaggggcgtctcgcgcgcaaggtcgtgtccgaggacgtgacggaagcggaagtcgctgccgcgatccggcggccgaccgaagggcgccggtacctgatgggcgacgacgagcagatgccgcgcgatacgctgccgcgccgctgagccggcagcctggcggatggccggcgtaccgggtgacgacggtagtgaatgaacaggccgggaccgtgcgcccggccttgtcgtatccgggcccgaagaaggacggatgggcctgtcgaggtgtcgcgatatcaaggtgctgcggtgccgaggcagccggcacgccgggctggcgtaccggccggttgcgccgcgacagcggtcagccgatctgctcgagctcttcctgcgcggcaagccagtcggcctcgaccgtctcgagacgcgtgttgacgtccccgagcttgcggatcgcatcggtcagctccgtcttgcgctcggcttcgtagctcgccggatcggcgacgaatgcgtcgaggcgtgccttctccgcgtgcagcgtctccatttccttttcgagcttcgtgatacgcgtctgcagcggcttcttcagcaccgacaggcgctggcgctcctcggcggcctgacgcttctggtccttgcggttggccgcggcacccgcgcccgacgaagccgcgctgtccgccttcgcggcggcgcgttgctcggccgcgtgctgcagcagccagtcgcggtagtcgtcgaggtcgccgtcgaacggctgcagccggtgcttcgcgaccagcatgaactggtcggtcgtcgcgcgcagcaggtggcggtcgtgcgagacgaggatcagcgtgccctcgaactgcgcgagcgccatcgtcagcgcatggcgcgtttcgaggtcgaggtggttggtcggttcgtcgagcagcagcaggttcggcttctgccagatgatcagcgcgagcgcgaggcgtgcctttcgccgcccgaaaacggcccgaccgggctggtggccatgtcgcccgaaaagttgaagccgccgaggaagtcgcgcagttcctgctcgcgcgtgtcgggcgcgagccgcgccagatgcgccagcggcgaatcgtcctcacgcagcgtttcgagctggtgctgcgcgaaatagccgatcgtcagtcccttgccgtcgcggacgtgccccgacagcggcgcgagcgtgccggccagcgtcttgatcagcgtcgacttgccctggccgttcgcgccgagcaggccgatgcgctgaccgttctggatcgacagcgcgacgcgctcgacgatcgggatctccgctccgccgtcggcgtggtagccgcagcggacgtcttccatcaccatcatcgggttcggcgcggcatcgggtgtgcggaattcgaacgtgaacggcgacgcgatgtgcgcgggcgcgatcagctccatcttctcgagcgccttcatccggctctgcgcctgcttggccttggtcgccttggccttgaagcggtcgacgaagctctgcaggtgttcgatcgtcttctgctgcttttcgtatgcgctttgctgcagcgccagctgttgcgcacgcagcacttcgaactgcgagtagttgccgccgtagcgcttcacctggcggttttccagatgcagcgtgacgttgcagatcgaatcgaggaattcgcgatcgtgagaaatcacgacgagcgtgccggggtagcggtgcagccagtcttcgagccagacgatcgcgtcgaggtcgaggtggttcgtcggttcgtcgagcagcagcaggtcggagcggcacatcagcgcctgcgcgagattcaggcgcatgcgccagccgccggagaaactggcgacggattcgcgcgtctgcgcgagcgtgaagccgagaccgagcagcagcgcctcggcacgggccggcgcggtgtagccgtcggcgtcggcgaacgccgcgtgcgcgtcggcttcggcggcgccgtcatgcgcggcggatgcggcggcgatacgcgcctcgatctcgcgcagcgcggcgtcgccgtcgagcgtgtagtcgagcgccgagcggtcgacggcgggcgtttcctgcgacacgtgggcgatccgccacgacggcggcatcgagaaatcgccgccgtcggagtgcagctcgccgcgcaggaccgagaacagcgtcgacttgccggcgccgttcgcgccgatcaggccggctttctcgccgggattgagtacgaaggaggtcgactcgaacagcggcttggtgccgcgcgcaaggctgaactgattgaaacggatcacggcggaaatgactggccaaaaccgctattctagactgcgcgccgcctgcgccgggcattggccgttcggcggatgccgcaatggagcaatttcgcctagactccacgtcgatccggtttcgtaaaaggagtgcccgatgtccaccctgtattcgttcagcgcagagacgcttgccggcgcgccggcctcgctcgacgcgtatcgcggcaaggtgctgctgatcgtcaacactgcgagcgagtgtggtttcacgccgcagtacgcgggcctgcagaagctgtacgaccagtacgcggcgcgtggcttctatgtgctcggctttccgtgcaaccagttcggcaagcaggagcccggcgacgccgcgcagattggcgcgttctgcgagcgcaattacggcgtcacgttcccgatgttcgcgaagatcgacgtgaagggcgaccatgcgcatccgctgtaccgctacctgaccgatgaggcgcccggcattctcggcctcaaggcgatcaagtggaacttcacgaaattcctgatcgatcgcgaagggcgcatcgtcaagcgctatgcgccgtccaccaagccggacgaaatcgccgcggatatcgacaagctgctgtgacggctgccggcggcgttcgcggcgccgatgcgggtcgcccgcccgccgtcgcggtcccggccgtcagaggatcggtgcgaacagtcgcgcgacgtgcatcgcgatgcgtcgccaggcaggcgagcggcggtattcgttcgcatcgacctcgtacgcctgtgcgaagtcggcaacgagcatcgtctcgacctcgtcggcgaatgcgcggtcgacggtcagcaccatgatctcgaaattgaggcggaacgagcggttgtcgagattcgcgctgccgatcgccgccgcgatgcggtcgatcagcacgaccttctggtgcaggaagccgggccggtagcggaataccttcacgcctgcatcgatcagatcgcgcgcgtacagcttcgacgcctcgaataccacgtagtgatcgcgccggctcggaatcaggatgcgcacgtcgacgccgcgcatgacggcgagcttcagcgcggagatcacggcttcgtcgggaacgaggtacggcgtggtgatccagacccgttcgcgcgcggcgttgatcgcctcgacgaagaacagcgagcccgtctcctgcttgtcggccggccccatcggcacggcgaggcaatgcatgttgtcgcccggctgcgcgggcggcggcatcgcgagcggcggcagcttctgcgtcgcccagtgccagtcttcggcgaacacgtactggatgctcgcgaccacgggtccgcgtatctcgatgtgcgtgtcgcgccacggcgacaggcgcggcttcgccccgagatattcgacgccgacgttgtggccgccgacgaacgcgcgattgccgtcgacgacgacgatcttgcggtggttgcggaaattgagctggaaacggttgacgaacttccggttggtcgcgaacggatgaacctcgacgccgccccggcgcaatgtgtcgacatagctgtgcggcaagtcgaagctgccgatgctgtcatacaggaggcagcagcgcacgccggctgccgcacgcgcgagcagcgagtcgcgcagcatccggccgagcgcatcgtcgcgcacgatgaagaactgcaccaccacgtaatcgcgcgcggcgtcgattgcggccaggatcgccgagaacgtcgcatcgccgttcacgagcgtgcgcaccgaattgccgccgaggaacggcatgccgccgagccgcgtgagcgcgagcaccgcggcctggccgatcgcgtcggcggccggcccgtcggtcgcgtcggtgctgagccagggcgagcggggtgtgtgcatgcgcaacatttccagctcgtggcgccgggcatcgacgtagccggagaacttgctgcgaccgaggaacaggtatggaacgagcgtcaggtacggcatggccgcaagcgagacggcccatgcgatcgcgccttgcgacgtgcgcgtgttcatgatcgcgtggcacgccgcgacgatcccgagcacatggatggtcaggatcagggtgccgagatgtagccagtcgagggtcatgggcgcgtgacggactcctgaggtcgcgcggccgggcggccgcctacgcgcatcttacccaaccgtgcggcgcaatggtgcgccgcacggcgggcgggccggaaaggctcaggccttgcgcggcaggtcggacgcctggatcaggaagacggcgtcgtcgcccgcgctggtgggcagccacgtgagttcgaggccgccgaacgcggcttcgacgttctcgcgctcgttgccgatctcgacgacgagcacgccgtcgtcgtgcagccagcgatgggcttcggcgacgatgcgtcgcacgatgtccatccgtcatcgccgcccgcgagcgccatctccggctcgtgacggtactcgggcggcagtgcggccatcgacgaggcattcacgtacggcgggttcgtcaggatcacgtcgtaacgcgtgcccgggtcggtgcggaacgcgggcagcggtgcgtagaggtcgccgtggtgcagtgcgacgcggtcttcgaggccgtagtcgcgcacgttgatctcggcgacttcgagggccttgtcggacaggtcgaccgcgtcgatctcggcattcgggaacgcgctcgccgcgaggatcgcgaggcagcccgagcccgtgcacagctcgagcacggcgccgacctgttcgggatcggcgacgtacggctgcagcccgtcgtcgagcagttcgccgatgaacgagcgcggcacgatcacgcgttcgtcgacatagaagcgatggccatgcatccaggcttcatgcgtgaggtacgcggccggcacgcggtcggtcgcgcgccgttcgatcaccgcgagcacggccgcgatttcgtcgggcaggagccgtgcgtcgaggaacggctcgagcgtgtcgagaggcagttcgagcgtgcgcagcacgaggtaggccgcttcgtcgtacgcattgtcggagccgtggccgaacgcgagcttcgccttcgagaagcgcgtgaccgcgtagcgcagcaggtcgcgaacagtggcaaaggtgtcgtcatgcgaggctccatcaggcgatcagttgttcgagcacgcggcggtacacgttcttcagcggatcgatgaagcgcacttcgatgtgctcgtcgatcttgtggatgctgccgttcggcgggccgaactcgatcacctgcgggcagatgcgcgcgatgaaacggccgtccgacgtgccgcccgtggtcgacagctcggtcgtgatgccggtctcggtgcggatcgcgttttccagcgcgcccgacagctcgccgcgcggcgtgaggaacggcaggccgctcaccgaccacttcagcgtgtattcgaggccgtgcttgtcgaggatcgcgtgcacgcgcgcctgcaggccctcgaccgtgctcgcggtcgagaagcggaagttgaacagcaggtcggcgtggccggggatcacgttggtcgcgccggtgccggcgtgcaggttcgacacctgccaggtcgtcggcgggaaatattcgttgccttcgtcccactgctcggcggcgagctcggcgagcgccggcgcgagcaggtggatcgggttcttcgcgaggtgcggataggcgatgtggccctgtacgcccttgacgaccagttcgcccgacatcgagccgcggcggccgttcttgacgacgtcgccgagttcgtgggtcgacgtcggttcgccgacgatgcagtagtccatgcgttcgccgcgcgcttcgagcagctcgacgaccttcacggtgccatcggtggcggggccttcctcgtcgctcgtgatcaggaacgcgatcgcgccgcggtggccggggtgtgccgcgacgaattcctcggatgcgacgacgaacgccgcgagcgacgtcttcatgtcggccgcgccgcggccatacagcttgccgtcccgatgggcggggatgaacggcggcgagctccattgctcgagcgggccggtcggtacgacgtcggtgtggcccgcgaaggcgagcagcttgccgtcgcggccgtcggcgccgcgcttgacggcccacaggttggtcacgccgtgcgacgcgatggtctcgcattcgaagccgagcgcggcgaggcgctcggtcaggatctgctggcaatgctggtcgtcgggcgtcacggacgcgcgggcgatcagctgttcggtaagggctagggtggcggacatggttcggaccactttcgataaaaatgccggcgcggtggccggcagcgacaagacgtcgggctgcgccgacaggcgcagcgcgggcagccctatgcggcaaacagcgccgcgtattgatcggccacgaagccgagcgatttcacgcggccgttgaccaccagcacgggacgcttgatgaccgacggcttgtggatcatcagcgcgaccgcgccggtcttcgtttcggcggccgccttcattgcgtcgtcgaggccgcgccacgtggtgccgcgcttgttgacgagtgcgtcgagcgacacgtccttcagccagtcttcgatcagcggcgcgctgacgccgagcttcttgaagtcgtggaactcgaattcgacgccgtgatcgtcgagccacacgcgggccttcttcacggtgtcgcagttcggaatgccgtagacgaccacggtgtgcggcttcgccatcagtcgcctcgcagcagctcgttcaggccgaccttcgcgcgcgtcttcgcgtcgaccttcttgacgatcaccgcgcaatacaggctgtgcgagccgtccttcgacggcaggttgccggcgacgacgaccgaaccggccgggatgcggccgtagctgacttcgcccgtctcgcgatcgtagatcttcgtgctctggccgaggtacacgcccatcgagatcaccgagttttcctcgacgatcacgccttcgacgacttccgagcgggcgccgatgaagcagttgtcttcgatgatgaccgggttcgcctgcagcggctcgagcacgccgccgatgccgacgccgcccgacaggtgcacgttcttgccgatctgcgcgcacgaaccgaccgttgcccacgtatcgaccatcgtgccttcgtcgacgtacgcgccgatgttggtgtacgacggcatcagcacgacgttcttcgcgatgaacgagccgcggcgcgcgatggccggcgggacgacgcggaagccgcctgcggcgaaatcctctgccgtgtagttcgcgaacttcgacggcaccttgtcgtagaactgcgagtagccgccggcgggcatcggcgcgttgtcctccaggcggaacgacagcagcacggccttcttcagccactggtgcacggtccagttgccgtcgatcttctcggcaacgcgcagcgcgcctttgtcgagctgctcgatcgcgtgcgcgacggcttcgcggacgtcggccggcgcggccttcggcgacagctcggcgcggttgtcccaggcggtatcgatgatttgctgaagttgttgcgacatgttcgttttcgcaggagattggatggaattgatcggatggacgattaccgcgcgagagaccggcagaaatcgacgatgcgttgcgcgccctcgacgcattcggggtgcccgcgacgagcgcgatccggatgaaatcgcggcccggattcgtgccgtgcgcatcgcgcgccaggtacgagccgggcagaaccgtcacattatagtcggcgtacaggcgacgggcgaactcggtgtccgacaggccggtgcgcgacacgttggcccacaggtagaacgccgcgtcgggcagtttcacgtcgatcacgtcggcgagcagcggcgtgaccgtgttgaacttctgcaggtacagcgcgcggttctcgcgcacgtgcgcctcgtcgttccacgcggcgatgctcgcgtgctgccagaccggcgacagcgccgcgccgtggtacgtgcggtacagcaggaatttcttcagcagcgcggcgtcgccggcgacaaaacccgagcgcatgcccggcacgttcgagcgtttcgacaggctcgacagcatcacgagccgctcgaagccgcggccgaggcggtgcgcggcctcgaggccgccgagcggcggtgccgcttcgtcgaaatagatttccgaatagcactcgtcggacgcgatcacgaaaccgtggcggtcggacagcgcgaacagctcgcgccagtcgtcgagcgtcagcacggcgcccgtcgggttgcccggcgagcacacgtacagcagctgcgtgcgcgcccagaccgcgtcgggcaccgacgcgtagtcgcacgcgaagttgcgggccgggtcgctgttcgcgaaatagggttcggcaccggccagcagcgccgcgccttcgtaaatttgatagaaaggattcggacagagtacgatcgccttctcgcccgtttcggacgggcgtgcgtcgatcaccgtctgggcaagcgagaacagcgcctcgcgcgagcccgacacgggcagcacctgcgtggccggatcgatggccggcagcccgtagcggcgctcgagccagtgcgcgatcgacgtacgcagcgcgtccgagccggcggtggccgggtacgacgcgagaccgtcgagcgcggccaccacggcgtcgcggatcagcgccggggtcgcatgtttgggctcgccgatgccgaagctgatcggtttgagggcgccggaaggcgtcacgtccttgaacagggcgcgcagcttttcgaaggggtagggctggagcgagtcgagtcgagggttcacgggcgaagcggccatcgcggccggttggagcgaaagaagcggcgggcgcgccgcgcggctgcgaacggcgccgcgggcgcacgggtcgcaacggacgattatagcgtgacggaacgcggtcacggcctgccggaacggcggccgggccggtcgaataatgggtatcgaaccaaatgaataacgcggtacgcggcagcctgccgacgctggccatcctgatcggcgcatcggtatggggcctgatctggtatccgctgcggatccttgcgtcgctcggcgtgacgggcacgctcgcgagcgcgctgacgagcctcgtcgcgttcctgttcgtgatcgtcgcgcggcaccgcacgatcgcgacgctgcgctggcactgggtgctggccggcatcgcggtgacggccggcgtgacgaacctcgggttcgtgtggggcacgatccacggcgaagtgctgcgcgtgatgctgctgttctacctgacccccgcgtggactgcgatctacgcgcacttcctgctgcgcgagcggctgacctgggccggcgcggggctcgcggcgctgtcgatcggcggcgcgatgctgatgctgtggtcgccggcgctcggcctgccgctgccggccagcccggccgaatgggccggcctcgctgccgggctgagtttcgcgatgagcaacgtgctcgtgatcaaggcgagccgcgaactgccggagatgcgcgcggagatgcgcaccgcgacgctgttcggcggcgcggccgtgtttggcgcgatcgcgtcgctgttcgagggctgccggctgcgccggcgggcggccagctcggtgtcgccgcgctgatcatcgtcgcgatcggcgtgacgatggcatcgaacaacctgctcgtgcagtacgggctcgcgcgtgtgccggcgaaccgtgcgtcgatcatcatgctgttcgagatcgtgatcaccgcgctgtcggcgtgggtgttcgcgaacgagctgccgaccgcgcgcgagtgggcgggcggtgcatgcatcgtgctggccacgctgctgtcgagccgggtccatcgtgccgcgccggcaccggacaaacccggcgacggtcgggacggtgcacgcgcgatggtatgatggaagccgtttgcggggcccaacgctggatgcgcgcggccccgcttttgaattccggggcgcgtcgcgcgcatgggccgtccggcctcgcgcagtgcggctccgtccgtttcacaccttcttcacatccgataccgccgtgcgtctgagctcgatcaaactcgctggcttcaaatcctttgtcgatcccacgcatttccaggttccgggccagcttgtcggcgtggtgggcccgaacgggtgcggcaagtccaacatcatcgacgccgtgcgctgggtgctcggcgagtcgcgcgcttccgagctgcgcggcgagtcgatgcaggacgtgatcttcaacggctcgaccgcccgcaagcccggcagccgggccagcgtcgaactgatcttcgacaactccgacggccgcgcggccggccagtggggccagtacggcgagatcgccgtgaagcgcgtgctcacgcgcgacggcacgtcgagttattacatcaataacctgccggcgcgtcgccgcgacatccaggacatcttcctcggcacgggcctcgggccgcgtgcgtacgcgatcatcgggcagggcatgatcgcgcggatcatcgaggcgaagccggaagagctgcgcgtgttcctcgaggaagccgcgggcgtctcgaagtacaaggagcgccgccgcgaaaccgagaaccgcctgcacgacacgcgcgagaacctgacgcgcgtcgaggacatcgtccgcgaactcggtgcgaacctcgagaagctcgaggcgcaggccgtcgtcgcgaccaagtacaaggaactcgtcgccgacggcgaggagaagcagcgcctgctgtggctgctgcgcaagaacgaggccgcgggcgagcagcagaagcagcagcgcgcgatcgaacaggcgcagatcgacctcgaggcgcagacggcgaagctgcgcgaggtcgaggcgcagctcgagacactgcgtgtcgcgcattactcggcgagcgacgcgatgcagggcgcgcagggttcgctctacgaggcgaatgccgaggtgagccgcctcgaagccgagatcaagttcatcgtcgaatcgcgcaatcgtgtgcaggcgcagatcgccgcgctgaacgcgcagcgcgagcaatggcgcgcgcaggccgagaaggcgcaggacgagctcgaggaagccgaggaagcgcgcgcgatggccgacgagaaggccgcgctcgccgaagacaacgccgccgcgaagcacgacgcgctgccggcgctcgaagcgaaatggcgcgatgcgcaggcgcagctcaacgacgagcgcgcgcggatcgcgcagaccgaacagtcgctgaaactcgaggccgcgcaccagcgcaacgccgaccagcagcttcagcagcttcagcagcgccatgagcgcctgaagagcgaagcgggcgggctcgacgcgccggacgaggcccagctcgaagagctgcgcatgcagctggccgagcaggaagagatccttgccgaagcgcaggcgcgcctcgccgacgcgcaggaaacggtgccgcgcctcgatggcgaacgccgtgccgcgcaggagcgcgtgcaggccgaggccgcgcagatccaccagttggaggcgcgtctcgcagcgttgaagcaactgcaggaaaacgtgcagaccgaaggcaaggtgcagccgtggctcgacaagcacgagctcggcgcgctgccgcgcctgtggaagaagctgcacgtcgaggccggctgggaagcggcgctcgaggccgtgctgcgcgagcgtctcgccgcgctcgaagtgtcgaatctcgactgggtgaaggcattcgcgaccgatgcgccgccggcaaagctcgcgttctatgcgccgcccgcggccggcgaaccgcccgcggccgtggcgggcctgcgtccggtgctgtcgctcgtgcgcatcgacgatgcgggcatccgtgcggtgctgaacgactggctcggcaacgtgtatgtcgccgacgacgtcgcacaggcgctcgcgacgcgcacgcagctgccggcaggcggcgcgttcgtcgtcaaggccggccatgtcgtcacgcgcgtcggcgtgcagctctacgccgccgattcggagcaggccgggatgctggcccgccagcaggaaatcgaaaacctgacgcgccaggtgcgtgcgcaggcgctgctcgccgacgaggcgcgcacggccgccgtgcgcgcggaagccgcgcacacgcaggccacgcaggcgctcggcgacgtgcgcgcacaggccgagcgtgcgacgcaacgcgtgcacgcgctgcagatggacgtgctgaagctcgcgcaggcgcacgaacgttacacgcagcgcagcacgcagatccgcgaggaactcgaggaaatcggcgcgcagatcgaagagcagcgcgcgatgcgcgcggaatcggaagcgaatttcgagcgtttcgacggcgaactcgcggagctgcaggcgcgcttcgaggacaaccagctcgcattcgaagcactcgacgaatcgctgacgcaggcgcgtcaggaggcgcgtgacctggagcgcggcgcgaacgacgcgcgcttcgccgcgcgcaacgcggtgacgcggatcgacgaactcaagcgcagcatccaggtcgcgcacgagcagagcgaacgtgttgccggatcgctggaagacgcacgcgccgaactcgagacgatcaacgagcagaccgcgcacacgggcctgcaggacgcgctcgaagttcgtgcggtgaaggaagaggcgctgcaggccgcgcggatcgaactcgacgacctgaccgcgaagctgcgcgcgtcggacgagcagcggctcgtcgccgagcgctcgctgcagccgctgcgcgaccgcatcaccgaattgcagttgaaggagcaggccgcgcgcctggcggtcgagcagttcgccgagcaactgacggcggccgaggtcgacgaggaagcgctgcgcgagaagctcacgccggatctgaagccgtcgtacctgcaaggcgaggtcacgcgcctgaacaatgcgatcaatgcgctcggcccggtgaacatggccgcgctcgacgagctgaaggccgcgagcgagcgcaaggtgttcctcgacgcgcagtcggccgacctgatcgacgcgatcacgacgctcgaggacgcgatccacaagatcgaccaggaaacccgcacgctgctgcaaggcactttcgacgaggtcaaccgtcacttcagcgacctgttcccgcgcctgttcggcggcggccaggcgaagctgatcatgacgggcgacgagatcctcgatgccggcgtgcaggtgatggcgcagccgcccggcaagaagaacgcgacgattcacctgctgtcgggcggcgagaaggcgctgaccgcgaccgcactggtgttcgcgatgttccagctcaatccggcgccgttctgtctgctcgacgaggtcgacgcgccgctcgacgacgcgaacaccgagcgtttcgcgaatctcgtgcgcgcgatgtccgacaagacgcagttcctgttcatctcgcacaacaagatcgcgatggagatggcgcagcagctgatcggcgtgacgatgcaggagcagggcgtgtcgcggatcgtcgcggtggacatggaaaccgccgcgggttttgcccagaattgacgtttgacgaaaccggaccgcgttcgcgcggcgcatgggcgcccgttcgcggttccgacgaacaagaattgctgatggagcgtgcatggacgagttgacactcggtttgatcggcgcgggcgccgtcgtggtgggcggcgtcgtggtctacaacgcatggcagggcgcgaaggtacggcgcaggatgccgcgcccgatgccggaggaagcggccgaggcgatgaaccgccccgagcgcgacgaagagttgccgttcatcgagccggtgcgtcagccggtgcggcgcgagcctgcggcgccggctgctgcggctgccgcgtcggcggaagtcgcgcgcgtcgagccgaccttcggcggtgcggcgcctgccgacatgccggccgatctgcaggccgaggcgaccggcgtcgagtcgccggccgagccggtcgacgcggttgccggcgaagacaccgtgccggccgccgcgcacgacacgcacgctgaagcggccgagccggtcgaacccgtgctgccggccgcgacgacgatctcgtcggcaccgccggcgatcgtcgaccgccggatcgactgcatcgtgccgatccgcctcaccggtttgctgccgggcgacaagatcctgccggccgcgcagctgcgccgcgcgggcagcaagcccgtgcatatcgaaggcaagcccgaaggcggccagtgggagctgctgcagaacggcgtgcgctacgaggaactgcgcgcggccgcgcagctcgcgaaccgcagcggcgcgctgaacgagctcgagttctccgaattcgtgacgggtgtccagcagttcgccgacgcgatcgacggcgcgccggaattcccggacatgatggaaacggtcgcgatggcgcgcgagctcgacgcgtttgccgcgcaatgcgacgcccagttgtcgatcaacgtgatgtcggacggcgcgccgtggtcggcgaactacgtgcaggcggtcgcgtcgcaggacgggctgctgctgtcgcgcgacggcacgcgtttcgtgaagctcgacgcgaagcagaacccggtgttcatgctgcagttcggcgacacgaacttcctgcgtgacgacctcacgtacaagggcggcaacatgatcacgctggtgctcgacgtgcccgtcgccgaagaggacatcctgccgttccggctgatgtgcgactacgcgaagtcgctgtccgaacggatcggtgcgcgggtcgtcgacgattcgcgccggccgctgccggaatcgacgctcgtcgcgatcgaccagcaactgatgaagctgtacgcgaagctcgaggaagccggcatcccggccggttcgccggtcacgcgccgcctcttcagccagtaacgcgaacgcacgggcggcgggcttcggcgccgccgttcgtcgctgcggcgcacacctcgctgtttgcgctgcagcacgcgcatcgggcgcgttttgcgcgccccgccacggcggcaaactgagataatcgggcatccgattttctcagaacgaatctgccgccagcatggcccgaacccaagccgaaccgccagccagccagcccgacgcgcgcgccgcgtggctgcgcgaccaactcgagcgggcgaactacgcctactacgtgctcgatcagccggatctgcccgacgccgagtacgaccgactgtttcgcgagttgcagcagctcgaaaccgatcatcccgaactcgtgacgcccgattcgccgacgcaacgcgtgggcggcgaggcggccggcggcttcacgccggtcgtccacgacgcgccgatgctgtcgctgaacaacggctttgccgacgaggacatcgtcgcgttcgacaagcgcgtcgccgatgcgctcgacaaggcgaccgatctcgccggttcggtgacggagccggtcgactacgcgtgcgaactgaagttcgacggtctcgcgatctcgctgcgttacgagcaaggcatattcgtgcaggcgtcgacgcgcggcgacggcacgaccggcgaggacgtgaccgagaacgtgcgcacgatccgctcgattccgctgaagctgaagggcaagaacgtgccggccgtactcgacgtgcgcggcgaggtgctgatgttcaagcgcgatttcgcacgcctgaacgaacgccagcgcgcggccgagcagcgcgaattcgcgaacccgcgcaacgccgcggccggcagcctgcgccagctcgactcgaagatcaccgcgcagcgtccgctgtcgttcttcgcgtacgggatcggcgtgctcgacgggatgccgatgcccgatacgcacagcgcgctgctcgactggtacgagtcgctcggcctgcccgtgaaccgcgagcgcgcggtcgtgcagggcgccgagggcttgctcgacttcttccgcaaggtcggcgagaagcgcgagtcgctgccctacgacatcgacggtgtcgtctacaaggtcaaccggcgtgacgagcaggagcgcctcggcttcgtgtcgcgtgcgccgcgctttgcgctcgctcacaagttccccgcgcaggaagcgctgacgaagctcgtcgcgatcgacgtgcaggtcgggcgcaccggcgcgatcacgccggtcgcgcgcctcgagccggtgttcgtcggcggtgcgacggtgaccaacgcgacgctgcacaacgaggacgaggtgcgccgcaaggacatccggatcggcgataccgtgatcgtgcgccgcgccggcgacgtgatccccgaggtggtcggcgcgctgctcgaccggcgcccggccgatgcggccgaattcgtgatgccgaccgaatgcccggtgtgcggctcgaagatcgagcgcctgccggacgaggcgatcgcgcgctgcacgggcggcctgttctgcccggcgcagcgcaagcaggcgctgtggcacttcgcgcagcgccgcgcgctcgacatcgacggtctcggcgagaagatcatcgaccagctcgtcgaactgaatctcgtgcgcacgccggccgacctgttcaatctcggctttgcgacgctcgccgagctcgaccggtttgccgagaagtccgcacagaacctgctcgactcgctcgagaaggcgaagcacacgacgctcgcgcgcttcatctacgggctcggtatccgccacgtgggcgaatcgaccgcgaaggatctcgcgaagcatttcggctcgctcacgccgatcatggacgcgtcgatcgaagagctgctcgaagtcaacgacgtcgggccgatcgtcgccgagtcgattcatcagttcttcgcggaagagcacaaccggaccgtgatcgagcagttgcgcgcaccgggcaaggtgacgtggccggaagggccgcccgcgccgaaggcgccgcagggcgtgctggccggcaagaccgtcgtgctgacgggcacgctgccgacgctcacgcgcgatgccgcgaaggaaatgctcgaagcggcgggcgcgaaagtggccggttcggtatcgaagaagacggattacgtggtcgcgggcgccgaagccggcagcaagctcgcgaaggccgaggaactcggcatccccgtgctggacgaagacggtctgcaccaactcctggagggcaatacgccatgattcgcgagatcctgaagatgggcgatccgcgcctgctcgaagtcgccaagccggtcgagcggttcgatacacccgagctgcacgagatcgtcgcggacatgttcgagacgatgcaccatgcgaacggcgccggcctggccgcgccgcagatcggcgtcgggctgcagatcatcatcttcggcttcggcaacaacaaccgctacccggaagcgccgccggtgcccgagaccgtgctgatcaacccgaaggtcgagtacctgccgccggacatggaagagggctgggaaggctgcctgtcggtgccgggcatgcgcggcgtcgtcagccgctatgcgaaggtgcgctacagcggcttcgaccagttcggcgagaagatcgatcgtgtcgccgacggttttcacgcacgcgtcgtccagcacgaatacgaccacctgatcggcaagctgtatccgatgcggatcaccgatttcacgcgcttcggcttcacggaagtgctgttcccggggctcgacccggcttccgacgactgatccctctgctttcccggtttctcgcagacaagaaaaagcccgcttgcgcgggctttttcattgcatggcgcacgtgtggcgcgccggcggtcagaacgtctcgtcggccgacagatagcgccattgcccctgcggcagtgcgccgagcatcacgcggcccatccggacgcgcttcaggccgatcacgtcgagacccaccagttcgcacatgcgacggatctggcgcttcttgccttcgcgcagcacgaagcgcaactgctcgccgttctgccagctcaccatcgcgggcttcagcgcgacgccgtcgagctcgaggccgtggcgcagcttcgcgagcgattccgccgggaagtgctggtcgatgtcgatcagccgttcgccgaagcgcacgcgcaccaggtattccttgtcgatatccgactgctcgccgatcagctgcttcgcgatcacgccgttctgcgtcagcacgagcaggccggtcgaatcgatgtccaggcggccggccggtgcgagcgcgtgcaggtgctgcggcgagaagcgtaccggcgaatggtcgccgctccagcggttcgcgcgcgtgatcagcacggctgccggctcgtagccgtcttccgcctggcccgacacataaccgacgggcttgtgcagcaggatcgtcacttgcgcggcctgcgcggcgctcgcgcgctcgtcgatctcgatcttctggtcggcgcggaccttggtgccgagcgtgtcgatgcgttcgccgtcgacgagcacccaacccttttcgatccattcgtcggcctcgcggcgcgagcacatgccgagctcggacatccgcttcgacaagcgcatcaggcccgtttcgtcgccgtagtcgacgtcggccgccgcgcgcttgaccggttgcgcggtcttgaccgcaccgaacgagcggcgttcgccgtcgcgcgcggggcgagccgggcggtcgccgaagctgcgcttcgtgccttcgccggccgtcttgtcgcgataggacgggcgcttgccgtcgtcggcgcctgcgcggcgcggacgggcatcgtcatcgcggcgcggcggacgatcggacgacgggcggcggtcgccgaagctgcgcttcgcaccttcaccggctgccttgtcgcgataggacgagcgtttgtcgtcgtcgccacctgcgcggcgcggacgggcatcgtcatcgcggcgcggcggacgatcggacgacgggcggcgatcgccgaagctgcgcttcgccccttcaccggctgccttgtcgcgataggggcacgcgggccgccttcaccaccggcgcgacgcggacgtgcgtcgtcatcgcggcgcggcggacgatcggacgacgggcgacggtcgccgaagctgcgcttcgcgccttcgccggatgcattgtctcggtacggcgcgcgtgcgccgccttcaccaccggcgcgacgcggacgtgcatcgtcatcgcggcggggcgggcgatcggacgacgtgcgacggtcgccgaagttgcgctttgcaccttcaccggctgccttgtcgcgataggacgagtgtttgtcgtcgtcgccaccggcgcgacgcggacgggcatcgtcatcgcggcgcggcggacgatcggacgacgggcggcgatcgccgaagctgcgcttcgccccttcgccggccgcgttgtcgcgatacggcgcgcgcgtgccgcgttcggcaccgccgtcacgcggcgcacgcttggccggtgcgcgatccgcgcccgggcgctcggcgccggccgcgccgcgcggcttgaacgagcgttcgccggcggcggccggggcggccttcttcgggcgggccggcttgtcccctgcgggcggcgcagcgggacgcaccgccttgcgggcgacgaggctgccggagcggacaggggcgcgggtcggcgacgccggcttcggattcttgacggttagtttggtgcgcataaacgctggaattcattcagactgcgatcgcacgcagcaactcggtttcaagctggatctgcaggcggttgtcggacaggccggcacccgcgagcaggaagatgtcctcgacgcgttcgccgagcgtattgatccgcgccgcgtggacgccgatccgatgctcggcgagtacgcgcgcgatcgaatagaaggcccggccggtcgttggccgacacggacaggatgtagtactggccgcgctcgtcggcccgcaggtcgacgcgcggcgtgatcggaaacgtccgggacagcctcgacaggcggcccttggacggctccggcagcggtgcggtttcggcgagccgcgacgcgagctgttgttcgacgagattcgcgatgtcgcggtagcgcacgtcgcgttcggtctgcgtgacgatgaagttgtcgagcgcgtagccgtgccgcgtcgtgctgacgcgtgcgtcgagcaccgacagcccgttgcggtcgaaatacgcgcagatgcccgcgaacaggtcggggcgatccttcacgtacacgagcacctgcagcgcgtcgccgattggcgacggccgtgcgcggacgatcgcggtttcggcgttcacgtgccggtacagcacgcgtgtctgccacgcgatgtcggctgcgtcgtgacgcaggaagaagccgacgtcgagctggtcccacagcgcgcgatgggcgtcctcgggcacggtctcgaggcgcagcagcgcgagcgcctgctcctgccgcgacttcagctccgaatgcgcgtcggggttggcgccgccgagcaccgcgagcgtgatgcggtacaggtcctcgagcagcttgcctttccacgtgttccacaccttcgggctcgtgccgcggatatcggcgacggtcagcaggtacagcgcggtgaggtagcgttcgttgccgacgacttcggcaaagcgcttgatgacttcagggtcgctcgtgtcctgcttctgcgcgacctggctcatcgtcaggtgatgctggacgagccacacgatcaacgacgcgtcgtcgccggcgatgccgtgctcgcggcagaagcgccgcgcatcggccatcccgagcgtcgagtgatcgccgccgcggcccttcgcgatgtcgtggaacagcgcggcgacatacagcacccacgggcgctcgaagttgccgatcaactggctgcagaacggatattcgtgcgcgtgctcggccaccgcgaagcggcggatgttgcgcaacaccatcaggatgtgctggtcgaccgtgtacacgtggtacaggtcgtgctgcatctggccgacgatgcggcggaagttcagcagatagcggccgagcacgctcgtctggttcatcagccggaacgcgtgcgtgatgccttcgggctgctgcaggatccgcatgaacgtgtcgcggttctgcggatcgcggcgccacgcgttgttcatgatctcgcgcgagttgtacagcgcgcgcagcgtgcgggcggacaggcccttcacgccgcgggtcgtctcgtaaagcaggaacgcttcgaggatcgcgtcgggatggcgctcgaacacgccgtcgtcgacgatctcgagcatcccctgcttctcgacgaagcggtcgggcgacagcacgcgcgtgatgccgctcgtcgcgggaaagagctgcgcctcgatgttctggatcaggatcgtcgcgagctgcgtgacggctttcgcggcccagtaatagcggcgcatcagctgctcgctcgcgcgcttggtctgcgtcggctggtagccgaagctctcggccgcctgcgtctgcaggtcgaacacgagcatgtcctggcggcggccggcgatcacgtgcagccgcgcgcgcagcgtcttcaggaagccttcgttgcggcgcagctcgcgcgcttcgcgatcggtaatgaggccgcgcgtgtcgagttcgcgccagctgctgccgaagcctgccgcgcgcgcgatccacaggatcgtctgcaggtcgcgcagcccgccggggctttccttcacgtttggctcgaggctgtacggcgtgtcctggaacttcgcgtggcgctggcgcatctcgagcaccttcgcggtgaagaacgcgcgggcgtcgagcgcctcgtggtagcgcaccgtgaagcgctcgaacagcgcggtgctgccgacgatgcggcgcgcttccagcagggacgtttgcaccgtgacgtcctgcgacgcctcctcgatgcactgcgcgaccgtgcgcacgctgctgccgatctcgaggccgagatcccacgccatcccgatgaagcgttcgatgcgcgcgtcgagcgtggggtcgtgcgcatcgggcagcagcacgaggatgtcgacgtcggaatagggtgcgagctcgccgcgcccgtagccgccgacggcgacgagcgcgagcgtcgcgggcagcccgcagtcgtcccacacgcgcttgagcgcatcgtcggtgagtttcgacagcgcgtgcatcagggacgcgacgttcgtcgcgcggcgaaagcgctcgagcatctccgtcttggcggccttgaattcggcgcgccgcgacagcgcgtcgggcgagggggcggcgtgagcgctcatgggcggccggtcaggtgcaggtggtgcggatagggcgggctggcgcgaaggcgctcagaccgcggcggccggttgcgcgaacacggggcgtgccggcgtgccggccgacacggtcagcacctcgtagccggtttcggtgacgagcaccgtgtgctcccactgcgccgacaggctgcggtcgcgcgtcttgaccgtccactggtcgggcatcgtgcggatgtcgcgcttgccggcgttgatcatcggctcgatcgtgaagatcatcccggccttcagttcgatgccggtgcccggacggccgtagtggacgacctgcggatcctcgtggaacaccgtgccgatgccgtggccgcagtattcgcgcacgacgctgtagccttgcgcttccgcgtgcttctggatcgcgtagccgatgtcgccgaggtgcgcgccgggcttgacctggtcgatgccgagccacatgcattcgtaggtggtctgcacgaggcgcttcgcgaggatcgagccctcgccgacgatgaacatccggctggtgtcgccgaagtagccgttcttgatcacggtgatgtcgatgttcagcgcgtcgccgttcttgatcaccttctcgccgggaatgccgtggcagatcacgtcgttgaccgaaatgcaggtggccttcgggtacggcggatagccgggcggctggtagttcagcggtgccgggatcgtgccctgttcgttgagcatgaactcgtggcagaggcggtcgagttcggcggtcgtgatgcccgcgacgacgtgcggcgtgatgaagtcgagcacttcgctcgcgagacggcaggcgacgcgcatctcggcgatatcgtgttcgtttttgagcgtaatagccatcgaggtatgcctggaatgcggtgaattgacggattatcgcaccttctggcaggcgtcgcagcccctgccggcggtgcgggtgcgggttttcgcggattgtccggccggctgccgcgcggcaagcggaagtggtgagcgacttgagagcggacagatcggcgtgctatactctttggctaagtcgacatccaaatgccgtagtgccccattccggggcggcatcgcggtggaaggcttacggcacgggcgttttgcacgtgccgaatcgcaagccggcgcaaccagggtgccggccgcgcggaaatcgtgcctttcggggcaggttcgtgcggcggtacggcggccggcttaagacccaaccctcgtggagaatttacatggcagttacgatgcgccaaatgctggaagcgggtgtccacttcggtcaccagacgcgcttctggaacccgaagatggctccgttcattttcggtcaccgcaacaagattcacatcatcaacctcgaaaagacgctgccgatgttcacggacgcacagaagtacgtgcgccagctggcagcgaaccgcggcacgatcctgttcgtcggcacgaagcgtcaatcgcgtgacacgatcgcccaggaagcgcagcgcgcgggcatgccgtacgtcaacgcacgctggctcggcggcatgatgaccaacttcaagacgctgaaggtatcgatcaagcgcctgaaggacatggaagcggcagtcgaggcaggcgagctcgagaagatgagcaagaaggaagcgctgctgttcgaacgcgaaatcgcgaagctgcagaagtcgatcggcggcgtgaaggacatgggcggcattccggacgcaatcttcgtcgttgacgtcggctaccacaagattgccgtcacggaagcgaacaagctgggcgtgccggtcatcgccgtggtcgatacgaaccactcgccggaaggtgtggattacgtgatcccgggtaacgacgactcgagcaaggcagtcgcgctgtacgccgaaggcgtggccgacgcgatcctcgaaggccgtgcgaacgcggtcaacgaagtggtccaggccgcacgcggcgacgacgagtacgtcgaggaaaacgcgtaactggccccgagccggcgcaaaaggggctctcaacaggccccctttttgcttgtgcgccggacctgatcgcgccgaatcggcgcgggtccgaaacgattttcggccgttcgcgtccaagcgggcggcgttgtgaatacagactcaaggagcgaatgatggcggcaattaccgcaagcatggtggcagaactgcgcgcgaagaccgacgcaccgatgatggagtgcaagaaggcgctgacggaagccgacggcgatctggccaaggctgaagagctgctgcgcgtcaagctcggcaacaaggcgagcaaggcggcatcgcgcgtgacggcagaaggcgtcgtcgcatcgttcgtcggcggcaacgcaggcgcgctggtcgagctgaactgcgaaaccgacttcgtcgcgaagaacgacgacttcctcgcattctcgaagacggttgcagaactcgtcgcgacgcagaacccggccgacgtggcagcgctgtcggcactgccgctcgaaggctcgacggtcgacgcagtgcgtctggccctgatcggcaagatcggcgagaacgtctcgatccgccgtttcgtccgtttcgaaaccgcgaacaagatcgcaacgtacctgcacggcgcgcgtatcggcgtgatcgtcgagtacacgggcgcggaagagcaggtcggcaaggacgtcgcgatgcacatcgcggcaatgaagccggtcgcgctgtcgtcggctgacgtgccggcggaactgatcgagacggaacgccgcgtggccgagcagaaggctgcggaatcgggcaagccggccgagatcgtcgcgaagatggtcgacggtagcgtccagaagtacctgaaggaagtgtcgctgctgaaccagacgttcgtgaagaacgacaagcagacgatcgagcagatgctgaaggcagcgaatgcggcagtgcagaagttcgcgctgttcgtcgtcggcgaaggcatcgagaagcgccaggacgacttcgccgccgaagtggccgcgcaagtcgcagcagcaaagcagcagtaagccgtaagcagtcaggcagtatccgcggcgggcgtccgctccgccgcggtcggcgccgccgccggccggccgggaaacccggttcgaccgtcggcgcttgcccgaatcagtatttcgcccctacagttcgtggttgtcatcctctcgtcgctcggaagcccctatgtccaatgcctataaacgcgtcctcctcaaactctccggcgaagcgctgatgggcgacgatgccttcggcatcaatcgcgcgacgatcgaacggatggtggccgatatcgccgaagtcgtgcgtctcggtacgcagctcgcggtcgtgatcggtggcggtaatattttccgcggtgtcgcgggtggcgcggccggcatggatcgcgcgacggcggactacatggggatgctcgcgacgatgatgaacgcgctggcgctgcaggacgcgatgcgccacgccggcatcgaggcgcgcgtgcagtccgcgctgcgcatggaccaggttgtcgagccgtacatccggccccgcgcgattcgccagctcgaggaaggccgcgtcgtgatcttcgcggccggtacgggcaacccgttcttcacgacggacacggccgccgcgctgcgcggttcggaagtgggcgccgaggtcgtgctgaaggcgaccaaggtcgatggcgtatattctgccgatccgaagaaggatccgtcggccacgcgctacacgacgatcacgttcgacgaggcgatcagccgcaacctgcaggtgatggacgcgacggccttcgcgctgtgccgcgaccagaagctgccgattcgcgtgttttcgatcaacaagccgggcgcgctcaagcgcatcgtgctgggcgaggacgaaggtacgctcgtccacgtgtaaactcccgcggatgcgggccatcggctgcggcgcgacggacgcgccgggcagggcccgcgttctttgaaggttagaaggttcggaggttgaaatgagtgtcgctgataccaagaagggcgtcgagcaaaagatgcagcgctcgatcgaagcgttcaagaacgatctggcaaagatccgtacgggccgtgcacacaccggtctgctcgatcacgtgcaggtcgactactacgggtcgatggtgccgatctcgcaggtcgctaacctgacgctcgtcgatgcgcgcacgatcggcgtgcagccgtgggaaaagaacatggtcgccaaggtcgaaaaggccattcgcgaagccgacctgggcctgaacccggctacggccggcgacctgatccgcgtgccgatgcccgcgctgacggaagagcgccgccgcgaactgaccaaggtcgtcaagggcgaaggcgaaacggccaaggtcgcgatccgcaacctgcgccgcgacgcgaacgaagcactcaagaagctcgtgaaggacaaggaaatctcggaagacgacgagcgccgtgcgagcgacgacgtgcagaagctgaccgacaagcacgttgccgaaatcgacaagctcgtgcagaccaaggaagccgagatcatgacggtctgacgaccgtcctcgcgcgccgccttcttcccgcaactgtctcaacggccatgacctataccagctctaccgttcgcgtgcctgacgtcggtgtcgtgccgcgtcacatcgcgatcatcatggacggcaacggccgttgggcgaccgaacgccgcttgccgcgcgtcgcggggcatacccgcggcgtcgatgccgtgcgggcggtggtcgaaggctgcgcgcgcgccggcgtcgaatacctgacgctgttcgcgttcagttcggaaaactggcgccggccgaacgacgaagtgtcgttcctgatgcggctcttcatcaccgcgctcgagcgcgaggtcggcaagctccatgcgaatgggatccgcctgcgtgtcgtcggcgatctcgaccgtttcgagccgcgcatccgcgaactgattcgccgcgccgaaaccaagacggcgcgcaacacccgtcttacgctcaccatcgcggccaactacggcggccggtgggacatcctgcaggcgacgaagaagctcgtcgagcaggccgtgcgcgaagggcgcgaggtcgaagtgaccgaggacgcgttcgcgccgcacctggcgatggcctatgcgccggagcccgatctcttcatccgtaccggtggcgagcagcgtgtcagcaacttcctgctgtggcagctcgcgtacgccgaattctatttcaccgacaaatactggccggatttcgacggcgcggcactggccgacgccatggcgtcgtatacggagcgcgaacgtcgtttcggccgcacgagcgcacagctcgaaccgcaatcgcagaacgccgactccctttcatgctgaaaacccgtgtgatcacggcgatcgtgatgctggcggtactgctgccggtgacgctgttcgcgccgctcaccgcgttcggcgcgctgatcggcgtcgtgctcgtgttcgccgcgtgggaatgggcgcgcctgctcgctcggcggcgccggcccggtcgtctatgccgtcgtcgcggcgcttgcgctcgcggcaacggtgccgctcggcgtcgatgcggcttcgtcccgtcccctttcatggcagcgggcgtgttctggctgctggtcggcccgttcgcgctgcggcgcaagcccgaactcgcgggcggcgtctggcggccgttcctgctggcggccggcctcgtggtctttgcggcctgctggcatgcgctcgtcgcggcgcgcgcgctgggcgtgccgttcgtgctgtcgctgcttctggtcgtctggctggccgatatcggcgcatacttcgcgggcaaggccttcggaaagcgtaaactggccatcacgatcagccccggcaagagctgggaaggcgcgatcggcggctggctcgccgtgatggtcgtcgccggtgtcgcgatggtcgtgcacgcgttcgagccgaccctgttttccgcgttcgccgtgcgttacggaatgcccggcgcgtgggctgcactgacgctgctggtcgcgtacagcgtgatcggcgacctgttcgagtcgctgctgaagcggcaggcgggcgtgaaggattcgagcggactgctgcctggccatggcggcgtgctcgaccgtgtcgacgcgctgcttccggtgctgccgctcgcgatgctgctgcttggttaaaccactatttctgttatgcaaaaacgtctgacattgctcggttccacgggctcgatcggagacagcacgctcgacgtggtcgcgcgccatcccgagcgcttctcggtctacgcgctgaccgcacaccgcaacggcgacaagctggtcgagcaatgcctgcgcttcgcgcctgaagtggcggtggtcggcgatgccgcgaccgccgcgcacgtcgaagcgaaactgcgtgcggcgggcagcaagacgaccgtgctgcacgggccgcaggcgctcgtcgacgtgtcgaagagcgacggctgcgacacggtggtcgcggcgatcgtcggtgcggccggcctcgcgccgagcctcgcggccgcgcgcgccggcaagcgcatcctgctcgcgaacaaggaatcgctggtgatgtcgggcgcgatcttcatggacgccgtgcgcgaccatggcgcgatcctgctgccggtcgacagcgaacacaacgcgatcttccagtgcatgccgcgcgacgagaacgagcacggcgggatctcgaagatcatcctgaccgcgtcgggcggcccgttccgcacgcgcgaaccggccacgctcgtcgacgtgacgccggacgaggcgtgcaagcacccgaactgggtgatgggccgcaagatctcggtcgactccgcgacgatgatgaacaagggtctcgaggtgatcgaggcgcactggatcttcgggctgccgggcgaccggatcgacgtgctgatccatccgcagagcgtgatccattcgctcgtgtcgtaccgcgacggctcggtgctcgcccagctcggcaaccccgacatgcgcacgccgatcgcgcacgcactcgcgttccccgagcgcgtcgatgcgggcgtcgatcagctcgacctcgcgcagatcgcccagctgtcgttcgagaagcctgattacgcgcgcttcccgtgcctcgcgctcgcgctgaaggcactcgaggaaggcggtatcgcgagcgccgcattgaacgcggcgaacgaagtggcggtcgaagcatttctcgcgcgccgcatcggcttcatggcgattgcggcgacggtcgacgccgtgctcaacacgctgccgaaccgcgcgcccgacgggctcgacgacgtcctggcggcggatgcagaggcacgccgcctcgccgccgagatcattgccaaagcgcctgcgccacgcgtggagcgcactgtctgaatggggtgctcatgaacgtgctggtcgaactgatcgcgtttgcggtggcgatcggggtgctggtcgtcgtgcatgagtacggacattatcgcgtcgcgcgctggtgcggcgtgaaggtgctgcgtttctcgatcggcttcggccagcccgtcgcgcgctgggtcagccgccggacgggcaccgagtggacgctgtccgcgttgccgctcggcggctacgtgaagatgctcgacgaacgcgatcccggccccggcatcccgcccgaggagctcggccaggcgttcaaccggcaatcggtctacaagcgcatcgcgatcgtcgcggccgggccgattgccaacttcctgttggcaattctcctgttttccgtcgtatttgccaccggtgtgaccgagccggccgcgatcgtcgcgccgccggccgccggtacggcggcggcgcgcgcgggcttcgacggtggcgaggcgatcgtgtcgatccgcaacgtgcgcacgggcgacgcgcaagacggcgagtccgagccggtaaggtcgtggtcggacctgcgctggaagctgctcgcggccgcgttcgatcaccgcgagatcgtgctcggcgcgcgcgacggcaacacgacgttcgatttccgcgtcgacctgcgcaacgttcccgaaagtcagctcgacgacgatttcatggcccatctgggcttcgaggccggcggcggcacgctgtcggtcgcgtcggtgcagcccggcagcgcggcggagcaggcgggcctgaagtccggcgacaagctggtcgcgctcgatggcaagccgatcggcggcgcgacgcgcttcatcgatttcgtgaaacaccatgtgggcaagccgctcgagctgcagatcgagcgcgacggcgccgcgcagacggtgtcgatcgtgccgcagatgcagcgcgacgacgaatcggggcagcaggtcggccgtatcggtgcggcgctgtcgatgcatgcgccgtccgtcgacgtgcgttacgggccgatcgagagcctgcggctcggcgcgcatcgcacgtgggacatttccgtgtattcgctgcggatgttcgggcgcatgatcacgggcaacgcgtcgctgaagaacctgtccggcccggtgacgattgccgactacgcgggcaagagtgcgcggctcggtccgtcggcgttcctgtcgttcctcgcccttgtcagcattagccttggcgtcctgaacttgttgccgattcccgttttggacgggggcatctgttatattatgcggttgaagccgcgaccgggaaagccgtctcggagcgctggcagctgattctgcaaagagccgggttgatctgcatcgtcgcgttgtcggcgatcgcgctgttcaacgatctggctcggttaatccatttctgaagcgtcaggcggcggccgctgggcagccgcctgatttgatgcagctaaatattggggatgcatgttgttcaaacctcatcgttttgtacctaagacagttgcagcggccgcgctcgccgcgcacggcctcgcggcgcatgcagcggcaccgttcgtggtgcaagacatcaagatcgagggctgcagcgcgtcgaagcgggttcggtgttcgcctacctgccgatcaagcagggcgataccttcacggacgacaaggcatccgaagcaatccgcgcgctgtacgcgacgggctttttcaacgacgtacgcatcgccacgcagggcaacgtcgtgatcgtgcaggtgcaggagcgtccggccatcgcgtcgatcgacttcaccggcacgaaggaattcgacaaggacaacctgacgaaggcgctgcgcgcggtcggccttgccgacggccgttattacgacaaggcgctcgtcgacaaggcggagcaggagctcaagcgccagtacctcacgcgcggcttctacgcggccgaggtcaagacgacggtcacgccggtcgacgcgaaccgtgtgtcgatcctgttcgcggtggccgaaggcccgagcgcgaagatccgccagatcaacttcatcggcaacaaggcattcagcaccagcacgctgcgcgacgagatgcagctgtccacgccgaactggttctcctggtacacgaagaacgacctgtactcgaaggaaaagctgacgggcgacctcgaagcggtgcgctcgtactacctgaaccgcggctatctcgagttcaacatcgattcgacccaggtgtcgatctcgcccgacaagaaggacatgtacctgacggtcacgctgcacgaaggcgagccgtacacggtgtcgggcatcaagctgtcgggcaacctgctcgatcgcgaggccgaactcagcaagctgatcaagatcaagccgggcgaccgcttctcggccgaaaagctgcagcagaccaccaagtcgatcgtcgacaagctcggtgaatacggctatgcattcgcgaccgtcaacgcgcagccggacatcgaccaggcgaaccacaaggtgaacctgaacctcgtcgtcgatccgagccgccgcgtgtacgtgcgccggatcaacgtcgtcggcaacacgcgcacgcgcgacgaagtcgtgcgccgcgaaatgcgccagctcgaaagctcgtggttcgattcgaaccgcctcgcgctgtcgaaggatcgcgtgaaccgtctcggctacttcaccaacgtcgacgtgacgacggtgccggtcgacggcacgaacgaccaggtcgacgtgaacgtgaaggtcgatgaaaagccgaccggcgcgatcacgctgggcgccggcttctcgtcgacggacaaggtcgtgctgtcggcgggcgtgtcgcaggacaacgtgttcggctcgggtaccagcctgtcggtgaacgtcaacaccgcgaagagctaccgtacgctgaccgtcacgcaggtcgacccgtatttcacggtcgacggcatcaagcggatcacggacgtctactaccgcacgtaccagccgctctactattcgacgagctcgagcttccggatcatcagcgcgggcggcaacctgaagttcggcattccgttctcggaagtcgacaccgtctacttcggcgccggcttcgagcagaaccgtctcgacgtcgattcgaacacgccgcaaagctaccaggattacgtgaacgagttcggccgcgtgtcgaacacggtgccgctgacggtcgcgtggtcgcgcgacgcgcgtgacagcgcgctgattccgagccgcggctacttcacgcaggcgaacatggagtacggcgtaccggtcggcaagatccagtactacaaggccgacctgcaggcccagtactactattcgttctcgcgcggcttcatcctgggcctgaacctgcaaggcggctacggtaacggtatcggcaacccgtacccgatcttcaagaactactacgcgggcggtatcggctccgtgcgtggctacgagccgagctcgctgggcccgcgcgacacgaagacgaacgacccgatcggcggttcgaagatgctcgtcggcaacatcgagctgacgttcccgctgccgggcacgggctacgaccgcacgctgcgcgtgttcacgttcctcgacggcggtaacgtgtggggcaacgcgccgggcggcacgagtacgggcgccaacggcctgcgttacggctacggcgtgggtctcgcgtggatctcgccgatcggcccgctgaagctgagcctcggcttcccgctgcagaagcacgaaggcgaccagtaccagaaattccagttccagatcgggacggcgttctgaccgaacgcatgacaacagcaacgagagggtaattttgctaaccggtaagttttcgaaacgagtgatgtgcgcgctgaccgttgcgctggccttgggcgctgcgacggtgcacgcacaggacgtcgcccgcatcgcggcggtcaattcggatcggatcctgcgcgagtcggcgcccgcgaaggcggcgcagacgaagctcgaagccgagttcgcgaagcgtgacaaggatctgcaggatctggcggcacgcctgaagtcgatgtccgattcgctggacaagaacggcgcgtcgctgtcggcggccgatcgcgcgcagaagcagcgcgatctcgcccagctcgataccgacttccagcgcaagcagcgcgagttccgcgaagacctgaaccagcgccgcaacgaggagctggcggccgtgctcgagaaggcgaacaaggtcatcaagcagatcgccgagcagcagaattacgacctgatcgtgcaggaagccgtgtacgtcagcccgcgcatcgacatcaccgacaaggtgctcaaggcgctcgcgtccggctcgacgaactgaacggagcagacgacgaatggcattgacgcttgaggaactcgtaaagcggttcggcggcgagatcgccggcgacgcacagtgcaaggtgagcgggctcgcaccgctcgacaaggcaggcccgcagcaactcgcgttcctcgcgaatccgaagtacctgtcgcaggtcgagtcgacccgcgccggcgcggtgctgatcgcgccgaaggatctggaaaagctgggcgcggccgcgacgggtcgcaatttcattgtcacgccgaatccgtacgcgtacttcgcgcgcgtcgcgcagatgttcatcgatctggccacgccgcagcgtgccgccggcgtgcatccgagcgcgacgatcgatccggccgcgcaggtcgccgcgagcgcggtgatcggcccgcacgtgacggtcgaggcgggcgcggtgatcgaggacggcgtgcagctcgacgcgaacgtcttcatcggccgcggcacgacgatcggcgcgggctcgcacatctatccgaacgcgtcggtgtatcacggctgcaaggtcggcccgcgcgcgatcatccatgcgggcgccgtgatcggctccgacggtttcggcttcgcgccggatttcgtcggcgacggcgacgcgcgcaccggcagctgggtcaagatcccgcaggtcggcggcgtatcgatcggcccggacgtcgagatcggcgcgaacacgacgatcgaccgcggcgcgatggcggataccgtcatcgaagaatgcgtgaagatcgacaatcaggtgcagatcgcccacaactgccggatcggcgcctacacggtgatcgccggcaaggcgggcatcgcgggcagcacgacgatcggccgccactgcatgatcggcggcgcggccgggatcgccggccacgtgacgctcggcgactatgtcatcatcaccgcgaattcgggcgtatcgaagtcgctgccgaaggccggcatctataccagcgcgttcccggccgtcgaccacggcgaatggaacaagagcgccgcactcgtgcgcaacctcgacaagctgcgcgagcgcatcaaggcgctcgaggccgcgctcgccgcccagggcggcacgggcgcctgagcgcatcatgcgagacctcgaaccgggcacggccagcgcaaccggcccggtttgccagactgggccgcacggcggcccgcttcagcctttgcatcaccaccgcgcagcctctgcgtgagacgaaccatcatgagcactgaaaaatcaatctcgacatccacaagatcctcacgctgctgccgcatcgctacccgattctgctcgtcgatcgcgtgctcgaactcgaaccgcacaagggaatcaaagcgctgaagaacgtgtcgatcaacgagccgttcttccaggggcatttcccgaagcggccggtgatgccgggcgtgctgatcctcgaggcgctcgcgcaggccgcggcgctgctgaccttctcggaagagcagccgaaggatccggagaacacgctgtactacttcgtcgggatcgacggcgcgcgcttcaagcgtccggtcgaaccgggcgaccaactgattctgaacgtgacgttcgaacgctacatccgcggcatctggaaattcaaggcggtggcggaagtggacggcaaggtggcggcggaagccgaactgatgtgcacggtcaagacgaccgacgtggcgccctgagcgacgcggcacgcacaggcaacgcaacgcgacacatcacatcgagaggcaacggcgcatgaccaggattcatcccaccgcgattgtcgaaccgggcgcgcagatcgacgaatcggtagagatcggcccgtacgcgatcgtcggcccgcacgtcacgatcggcgcgcgtacgacgatcggctcgcacagcgtgatcgaaggccatacgacgctcggcgaggacaaccgcatcggccattacgcgtcggtcggcggccgtccgcaggacatgaagtacaaggacgagccgacgaagctcgtgatcggcagccgcaacacgatccgcgaattcacgacgatccacacgggcaccgtgcaggacggcggcgtgacgacgctcggcgacgacaactggatcatggcctatgtgcacatcggtcacgactgcaccgtcggcagccacgtgatcctgtcgagcaacgcgcagatggccggccacgtcgagatcggcgactgggcgatcgtcggcgggatgtcgggcgtccaccagttcgtgcgcatcggcgcgcactcgatgctcggggcgcttcggcgctcgtgcaggacattccgccgttcgtgatcgcggcgggcaacaaggcagagccgcacggcatcaacgtcgaagggctgcgtcggcgcggcttctcgcccgatgcgatctcggcgctgcgcagcgcttaccgcctgctgtacaagaacggcctgtcgttcgaggaagcgaaggtgcagctgcgcgagctcgcggaagcgggcggcgacggcgacgcggcggtcaaggcgttcgtcgagttcatcgacgcgtcgcaacgcggcatcatccgctaagcgatgccgcttccgaccactcagctccggctcgcgatggcggccggcgaaccgtcgggcgacctgctcggggcgtcgctgctcggcgggctgcgcgagcggctgcccgaatcggcccagtattacgggatcggcgggcagcggatgatcgcgcagggcttcgactcgcactggcagatggacaagctgaccgtgcgcggctacgtcgaggcgctcggccagattcccgagatcctgcggattcgcggtgagctgaagcgccagttgctcgccgagcgaccggacgcgttcatcggcatcgacgcgcccgacttcaacttcagcgtggaacaggccgcgcgcgacgcgggtatcccgtcgatccacttcgtgtgcccgtcgatctgggcatggcgcggcggccggatcaagaagatcgcgaagtccgtcgatcacatgctgtgcctgttcccgttcgaaccggcgattctcgacaaggcaggtgttgcttcgacctacgtcggccatccgctggccgacgagattccgctcgagcctgacatgcacggcgcgcgcatcgcgctcggattgccggccgacggcccggtgatcgcggtgctgccgggcagccggcgttcggaaatcgcgctgatcggcccgacgttctttgcggcgatggcgctgatgcagcagcgcgagcctggcgtgcggttcgtgatgccggcggcgacgcccgcgttgcgcgcgctgctgcagccgctcgtcgatgcgcatccgcagcttgcgctgacgctcaccgacggccgctcgcaggtcgcgatgacggcggctgacgcgatcctcgtgaagagcggcacggtcacgctggaagccgcgctgctgaagaagccgatggtgatctcctacaaggtgccctggctgaccgggcagatcatgcgccggcaggggtacctgccgtacgtcggcttgccgaacatcctggcggggcgtttcgtcgtgcccgagctgcagcacttcgcgacgcccgaggcgctcgccgatgcgacgctcacgcagctgcgcgacgacgcgaaccgccgcacactgaccgaagtattcaccgaaatgcatctttcgctgcggcagaacacggccgcgaaggcggccgaagcggtcgtgcgcgtgctcgaacaacgcaaggggcgcgcatgaccgcagtacgtgcaccacgccaccgcgcgtcgagcgacgtgcaggacggtttcgatttcagccggcccgacgagatcatctgcggcgtcgacgaagccggtcgtggcccgctcgcggggccggtggtggccgccgccgtgatcctcgatccggcgcagccgatcgacgggctcgacgattcgaaggcgctgtccgcgaagaagcgcgacgcgctgtacgacctgatcgtcgcacgttcgcgcgcgtattgcgtcgcgtcggcaagcgtcgacgaaatcgacacgctgaacatcctgcacgcgacgatgctcgcgatgaagcgggcggtcgagggcctgtcggtgctgccgacgctcgcgcagatcgatggcaaccgctgtccgacgctgacggtgcgtgccgaggcgatcgtcagcggcgatgcgctcgtgccgagcatctcggccgcgtcgattctcgcgaaggtcacgcgcgatcgcatgctcgtcgacctgcacgagcgtttcccggtgtacggcttcaacgtacatgcgggctacggcaccgcgaaacatcttgccgcgctacgcgagcacgggccatgcgaagcgcaccggcgctcgttcgcgccggttcgcgcggcactcgacctgattcgatgaaaagcatcacttcccgcgacaacccgctgtacaagcgcctgaaggcgctcgcgggctcgacgccccatcagcgccgcagcggccaggcgctgctcgaaggattccatctcgcgagcgcgtacctcgatacgggcgcgacgcccgagctgtgcgtggcgaccgaaggcgcactcggccacgcggaggcgcaggcgatcgtcgcgcgcatcgatgcgcaacgggtcgtcacattgcccgacgcgctgttcgggcagttgtcgaacgtcgtcaacggcgtcggcttcctgctgctcgtcgaccggccggcgcaaccgctgcccactcgcgtcacgcatacgtcggtcgtgctcgacggcgtgcaggacgccggcaacgtcggctcgatcctgcgcagcgcggcggccgcaggcgtgcgccacgtgttctgtgcgccggggacggcgtacgcatggtcgtcgaaggtgctgcgttcgggcatgggcgcgcatttcctgctgtcgatccacgaggatgtcgaagccggtgaactcgccgaacgcctcgatgtaccggttgcgctgaccgactcgcacggcgcgcaggcaatctacgattgcgacctgtcgggccccgtggcgtgggtgttcggcaacgagggcgcaggcgtctgcgcgtactggcgcgaggtggccacgcatcgcgtgacgattcctcagccgggcgggatggagtcgctgaacgtcgcagccgcggcggcggtgtgcctgttcgagcaggtgcgtcagcagcggtgagcgtgacgccacgctcgcgcattccccgcaccacgaaaaaggccgcgttcgacgcggccttttcgtttccggcggcgtctgggcggccgccggcgctcggccttagtacgactgccggtctaggcggacttcctgcaggatcgtcgtcgcgatttcctcgatcgacttgtgcgtcgacgacagccacttgatcccctcgcggcgcatcatcgcttccgcctcgttgatttcgtagcggcagttctcgggcgccgcgtacttgctgcccgggcgccgctcgttccggatctccgacaggcgctgcgggtcgatcgacagcccgaacagcttctcgcggtgcgaggcgagcgccgacggcagcttgccgcgttcgaagtcttccggaatcagcggatagttcgctgccttcacgccgtactgcatcgcgagatacaggctcgtcggcgtcttgccgctgcgcgacacgccgacgaggatcacgtcggcctccgacaggttgcggttcgactggccgtcgtcgtgcgcgagcgagaagttgatcgcctcgatccgggtcttgtattcctcggtgtccgcgttctggtgtccgcggcccatcgcgtggctcgacttgagctccagttcctgttcgagcggttcgacgaagcgctggaacatgtcgagcacgagtgcgttcgagcgtttgacgatgtcgttcgactcgctgtcgacgagcgtcgtgaacacgatcgcgcggcggccgtcgtgcacggcggcctcgttgatcttctcgacggtcgcataggccttgtcgagcgagtcgacgaacggcacgcgcacgagacggaatttctggtcgaactgggagaggatcgagtgcgcgaaggtttcggcagtgatcccggtgccgtcggagacgatgaatacggtaggcagcatgaatctggacgtcgagcgtgaagggcggttgcgcgggcggctggagggtcgcctccagacgcagtgacaaggtcgcgccacatccggcagccggcacggtagaatagcggcaacctgttggataagcaattgcgggggcagggcgcgaacggcgccccaggctttgccgctcgattccataattcccggcaagtttggcgatttgtctgcaaatatcgcccttctgccgggatttttgcaaatcgggtcggaagattttcgccgctgcgagtgtttctccaacaggttgcgcaagacgcgccgcgccttttgcaagcgcccgcgtccgagcccacttgcgcaatcgagcattttttcacacttaggggcttgtatgactaacgcagcaaacgtcgcaaaggaccaggcgtatgtaattccgttcgagcagttgcggatgaccgatgtggaaatcgtcggcggcaagaatgcgtcgcttggcgaaatgatcagccagctttccgaagcaggcgttcgcgtacccaccggtttcgccacgaccgcgctcgcgttccgcgatttcctcaagcacaacgaccttaccgaccgcatcgccaagcgtctcgagtcgctcgacatcgacgacgtgaaggcgctcgccgaagctggtgcggaaatccgcaagtggatcgtcgatgcgccgatgcaggcacgtctcgagcaggaaatccgcgagcagttcgacatcctgaagaacagttcgccgggcgagctgtcgttcgccgtgcgctcgtccgctaccgcggaagacctgcccgacgcatcgttcgccggtcagcaggagtcgtacctgaacgtcgtcggcatcgaagacgtgctcgaccgcatgaagcacgtgttcgcgtcgctgtacaacgaccgcgcgatctcgtaccgcgtgcacaagggcttcacgcacgcggaagtcgcgctgtcggccggtgtgcagcgcatggttcgctcggacgtcggcgcggccggcgtgatgttcacgatcgacaccgaatcgggcttcaaggacgccgtgttcatcacgtcgagctacggcctgggcgaaaccgtcgtgcagggcgcggtgaacccggacgagttctacgtgttcaagacgacgctcgctcaggacaagtacccgatcatccgccgctcgatcggctcgaagctgatcaagatggaattcacgcagccgggcgagccgggccgcgtgaagacggtcgacgtgccgcacgaacagcgcaaccgctactcgatcaccgacgaagacgtgatcgagctggcgaagtacgcggtcatcatcgagaagcactatcagcgtccgatggacatcgagtggggcaaggacggccgcgacggcaagatcttcatcttgcaggcacgcccggaaaccgtgaagagccaggcaaccggcaaggccgagcagcgcttcaagctgaagggccagtcgcaggtgctcgcgacgggtcgtgcgatcggccagaagataggcgcgggccccgtgcgcgtgatccaggatccgtcggaaatggaacgcgtgcagccgggcgacgtgctggtggccgacatgaccgacccgaactgggagccggtgatgaagcgtgcggccgcgatcgtcacgaaccgtggcggccggacctgccacgcggcgatcatcgcgcgtgaactcggcgtgccggcagtcgtcggctgcggcgatgcgaccgacgtcctgaaggacggcgcgctcgtcaccgtgtcgtgcgcggaaggcgacgaaggcaagatctacgacggcctgctcgagacggaagtcacggaagtgcagcgcggcgaactgccggaaatcccggtcaagatcatgatgaacgtcggcaacccgcagctcgcgttcgacttctcgcaactgccgaacggcggcgtgggtctcgcgcgtctcgagttcatcatcaacaacaacatcggcgttcacccgaaggcgatcctcgagtacccgaacatcgaccaggacctgaagaaggccgtcgagagcgtcgcgcgcggtcatgcatcgccgcgtcagttctacgtcgacaagctgacggaaggtgtcgcgacgatcgctgcggcgttctatccgaagcccgtgatcgtgcgtctgtccgacttcaagtcgaacgagtacaagaagctgatcggcggttcgcgttacgagccggacgaggaaaacccgatgctgggtttccgcggcgcatcgcgctacatcgctgaagacttcgcgcaggcgttcgagatggaatgccgcgcactgaagcgcgtgcgcgacgagatgggcctgaccaacgtcgagatcatggtgccgttcgtgcgtaccgtgaagcaggcggagcgtgtcgtcggcctgctcgagaagttcggcctgaagcgcggcgaaaacggcctgcgcctcgtgatgatgtgcgaagtcccgaccaacgcgatcctcgccgaagagttcctggagcacttcgacggtttctcgatcggctcgaacgacctcacgcagctcacgctcggccttgaccgcgattcgggcatggaactgctggctgtcgacttcgacgaacgtgacccggccgtcaagttcctgctgaagcgcgcgatcgatacctgccgcaagatgggcaagtacgtcggtatctgcggccagggcccgtccgatcatccggacttcgcgcaatggctgaccgacgaaggcatcgtgtcgatctcgctgaaccccgacacgatcatcgatacgtggcaggcgcttgccaaccggaagtaacggtcggcgatgccgcttcggcgaaagcgcggtgccgccgcgctttcgttgaaggcaaaatgcaaggttcgtgttataaacaccccggtacgcaccggggtgtttttatttgtcggtacgcaacgtgccgatccgggcgtgccggtcgcctccgctcgcggcagcgaatatagtgagtatcgggggcgtttttctggaggccaaaatgatgtcggggcatctgttctggtgggtcgcggtgggcgtgctggtcgtggccgaactgctgacgggcacgttctacctgctgatgatcgcactcggctttctcgcgggcggcttgctgcaactggctggtttcgcgccgcacgtgcagttcggtgcggcggccgcggtcgcgatcgtcgcgatgatcgcgctgcgccgctcggggctcggccgcaagcagaagcgcgacacgtcgacgaatcccgacgtcaatctcgacatcggctcgaccgttacggtcgatgcgtggcgcgacggccgtgcgcgcgtgcagtatcgcggcgccgactgggacgtcgagctcgcgaacggcgagcgcgacgatgcgcatgtgtatcaggtgagtgccgtgcgcggcaattgtctcgtggtcgtggcgaaacccgcgggctgatcgtccgccgatacaacaaggagggaatatttcatggattcgctgatcatctggattgtcctgctcgtcatcgcgatcgtgatcgtgtcgaagacggtgaagatcgtgccgcagcagcatgcatgggtgctcgagcgcttcgggcgctatcacgcgacgctgtcgcccggcctgaatatcgtgctgccgttcgtcgatcgcatcgcgtaccggcacgtgctgaaggaaatcccgctcgacgtgccgagccaggtctgtatcacgcgcgacaacacgcagctgcaggtcgacggcgtgctgtacttccaggtgaccgatccgatgaaggcgtcttacgggtcgagcaacttcgtgctcgcgatcacgcagctcgcgcaaacgaccttgcgttcggtggtcggcaagctcgaactcgacaagacgttcgaggagcgcgacttcatcaaccacaacatcgtgtcggcgctcgaccaggcagcggcgaactggggcgtgaaggtgctgcgttacgagatcaaggacctgacgccgccgaaggaaatcctgcacgcgatgcaggcgcagatcaccgcggagcgtgaaaagcgcgcgctgatcgccgcatccgaaggccgcaagcaggagcagatcaacctcgcgtcgggcgcgcgcgaagcggcgatccagaaatccgaaggcgagcgccaggctgcgatcaaccaggcgcagggcgaggccgctgcgattctggcggtggccgaggcgaacgcgcaggcgatccagaagatcgcgaacgcgatccagtcgcagggcgggatggatgcggtgaacctgaaggtcgccgagcagtatgtcgaggcgttctcgaatctcgcgaagcagggcaacacgctgatcgtgccgtcgaacctgtcggatctcggcaccgcgatctcgtcggcgctgacgatcgtcaagaacgcgggggcggcctcgggcgggaaggcctgattcgggcgtacgcggcgtgcgaagggcgcgccgcgtacgatcggtgtgcggcgaatcgtcgcgcagccggggcgcggatgatgcccgcggcacctttcttcggccgacgccggcggtatggcgtgcctcagccgccgccgcacagccggcatcggcgattcacgtagtccaaagcaacacggcccgcttcgagcgggccgtgtcgtttgcggggtgcgtcgcgcgtcaggtgccggcgcgcatgatgcgtgccttttcgcgttcccagtcgcgcttcttctcggtttcgcgcttgtcgtgcagcttcttgccctttgcgagcgcgatgtcgcacttcacgcgaccgcccttgtagtggaagttcagcggcacgagcgtgtacccgcgctgctcgaccttgccgatcagcttcttgatttcctcgcggtgcagcagcagcttgcgcgtgcgaaccgggtcgggcttgatgtgcgtcgaggcttcgggcagcgggctgatatgggtaccgatcaggaagatctcggcgttcttcaccacgacgtagccttccttgatctggccgcgcccggcgcgcagcgccttgacttcccagccctcaagcacgagccccgcctcgtagcgttcctcgatgtgataatcgaagtgcgctttcctgttgtcgatgatgctcatgaaaggatcgggccaactcgtttaaaatcacgattttagcaaagcagggcgggaatcgcccggcttgcgttctcaccttgagcgatgccgcgcgatttatggcagatgtccagaaaaccgtattgatccgtcattcggcggaacagatgttcgacctcgtcaccgacgtggccgattaccccaatttcctgccctggtgcggcggtgtcgaggttcgccgtcaggacgagagcgggatggaagcgcgcatcgacatcaacttcaagggcatcaagcagcacttcgcgacgcgcaacacgcagcagcgcccgactcggatcgacatggagttcacggacggcccgttcaagaagttcacgggctcgtggcgcttcacggcgctgcgtgccgatgcgtgcaagatcgaattcgcgctgcactacgagttctcgaacatcctgctcgagaagatcatcgggccggtgttcagccacatcgcgaacacgttcgtcgattcgttcgtgaagcgcgccgaccagcgctacgggaaggggtgacgcgatgctgtcgatcgaagtctgctacgcgttgccggatcgccagacgctgattccgctgtcgctccccgaagggcgaccgttcgttcggcgatcgatgcgagcggcgtgctcgcgctgcacccggaaatcgatctcgcgaacgcgaagacgggcgtgtacgggaagcttgcgccgctcgacacgctgctcgccgaccacgaccgcgtcgagatctaccgcccgttgatcgtcgatccgaaactcgcgcgccagcggcgcgtcgacaagtcgcgccgcgacggctccatcgagggccgcaagtggatgcacaaggacgcgcgctgacgcggagcgatccgcgtccttcaactcgattcgtctgagcaaacgccgcggcgttcaatgggctgcggcattcgcgtttgccggtgcgtttgccggcgcgcttcccgccgtcccgccgccggcgggcgtgtcgccatgccggcgcaccgatccatagacgccggcgagcagcagcaccagcgcggcgatctcgagcgcatgcggcatccgctggtcgtacacgaacgcgtaaagcatcgcgaatacggtttcgaacacgatcagctggcccgacagcgtgaggggcagccgcttcgacgccgcattccacagcccgttgccgagccacgacgcaccgatcgcgagcacgaggttcagcagccagaacaactgccagcgcgacgcgggcaccgcttcctggaacgtgccggccggcagcgcgaggatcgcgacccagacgagcccgccgatcaggcccgtcacgacaccccacaagaccgaccactcgttgccgccgaaacgatgatggcgctgcagataacgtgcgttcgcgaccgcataccaggtccagctcgcgagcgcgcccgccgcgcaggcgatgccggcgagtttctggccgagcgtcgtcgtatgtgcggcctcggacgtgaacaggtcgacgttgatgcagacgatgcccgcgatcaccagcgccagcggggcggcgagccggcgcaacggcacggcgccgtggtcgccgaggcctgcgagcgtcaccgtgacgggcagcacgccgacgatcagggagctgggtgcgatgccgatcaggtgcaccgcaccggacagcagcatgtagtacgcgacgttgccgatgacggcgagcctgaccagcgcgacgagatcctcgcgggtcagccgcgcgagcagcgagcgggccgccggcagcgcggccgcgagcgacacgagaccgtacatcgcatagcggccggcgctcagcagcagcggcgagaagtcggtcagcagccgcggaacgagaaacaccatgccccacagggcacctgccaggacaccatagaccacaccgcgctgcatcgactgctccgaacacgtgactgatgagcgcgcatcttagcgacgccgtcgcggcgtcgtcttgttcattcctgcactcggtgcaggccggtgggtgggcgcgcggcgcgcagcagcgatcgcggcaggcagcggatcagtcgtcagccggatcgggcgccgccgcaccgccgcccggtgcccgcgcccgcgcgggccgccgcacggcgcgcagcgtgccgctgttgccgccgccgcagtagaagcggtcgtggccgtcggattcgagccccgacacgccgacgccggccggcatgtcgatctgctcgagcacccggcccgtgcgcggatcgatgtgccgcaagtcggcctgatcggcttcccaggtgccgtgccacagctctccgtcgacccacgtcacgccggtgacgaagcggttcgactcgatcgtgcgcagcacggcgcccgactgcggatccacctgatgaatcttgcgatcgcggtactggccgacccacagcgcgccttcggcccatgccagccccgaatcgccgccgccgccgggagcgggaatcgtcgcgagcacgcggcccgattcggggtcgatcttctcgatgcggtcctcgacgatctggtacaggtggcggccgtcgaacgccgtgcccgcatgcgcggcgatgtcgatcgagcggacggtcgtgccgcgctccgggtcgagcgcattcagcttgtcgccggacgcgtaccacacgtacttcccgtcgaacgtgacgccgtgtacgccgtcgacgccgggaaacgggccgtattcgcgaaggatctctgcactggagcgtttcatgttcgtcacctcgtcgttcggtgaggtcatcctaatctcccggcagcggggcagggagtaacaaggtcgtcgcgaaaccgggcagcggcggcgtcatccagcggcgcgcgcggccgcggccgagcggttggaccttgtccgcttcggcgagcacgtcgagcgcgcgctgcacggtgcgctggctcgcgccgagggccagcgccagcgcggagctcgaccatgcttcgccatcggcgaggagagcgagcacggctgcgtgacgatcgtcgaccgggcgcgcgaggacgacggtctcgcgtacgccgagcggttcgagcgcaaagccgcgcggcgtcgcgacgatgtttgcgagcggccgcagcaccgcgcgcaaccggccgatctcgacgcgcaggcgcgcgcgatgcgattcgtccgcgtgtttcgcgcggaacgcggccgcgacgagcgcgtttcgcgacacgtcggccggccacgcctcgccgagcgcgcgggcgagcacgaacagcacgggccgccgcgcgagcgacacggtcgtgcgcgcgtcgcgtaccgtgtggcggcacgcgtcgacgacgagtgcgttcgacgcgaacagcgtctcgacttcgtcgagctgcacgagccgcgacgtgccgcgcgcgatgaggcgcgcggccggtgcgtcgagcgcgcgtgccgcggtgtcgatttcggccgtcagcgcggcgatgccggcttcgcgggccgccgcgcgcgcccgcacgagcgccgcgcgggccgcctgcgtgcggatgcggcgcatcgcgatgccggccgcgatcagctcatgggcggcgcgcgatgcagccggcagtggtgcgggatcgagattcgcgagcatccgttcggcgtcgtcgagctggccgaccagcagcagccggcgcacgccgagatggcgcgcgtgcgcggcgttcgcgcggtcaccgtgcgcgtcgagcgtcgcacaggctgcatcgagcgcgcgtgtcggccagcgcaagtcgcgcgatgcgagcgcgatctccgcttccgcgacgacgcagcgcgcacgcgccacggcctcccggggccgaacgcgcgtgcggcgccgcgcacgagtgtgcgcgcgcgttcgaaatcgccgagctgtgccatcgcgatcccgcgcagcgcgagcgccggcgcgtcgtcgcgcagcgcgacgcggttcagcgcgccgagcgcgtcaccggccgcgagcgcgcgcggccgccgtgatcagcgaatccatccgaatcccgacacacttgtcactccctccggcctgatgcccgccactaatctagcaccacgcacacggcaccggacgccgtgcccggctacccatcggaaggaggaacccgcaatgacgacccatctcaccggaacgcgcgacgaatggctggccgcgcggcgcgctgctcgacgcggaaaaggcgctgacgcggcaaagcgacgaactcgcgcggcggcgccaggcgctgccctgggtacgcatcgacaagacctaccggttcgacaccgaagacgggcaggccacgctcggcgacctgtttcgcggccgttcgcaactgctcgtctatcacttcatgttcggccccgactacaaggcaggctgcccgtcgtgttcggcgctcgccgacggtttcgacggcttcgccgtgcacctggcgaaccacgacgtgacgctcgccgccgtgtcgcgtgcgccgctcgcgacactcctcgcttaccggcagcggatggggtggcgcttcccgtgggcgtcgtcggtcggcagcgatttcaacttcgacttcaatgtgtcgttcaccgaaacgcagcagcgcgcgggcgccgtcgaatacaactacgcgctggccggccatgcgatggacatggatccgccgccggcacccgtcgtgcagttcgctgcgacgtgcggcaccgacgcgctcacgtattcgctcgaccggccggggatgagcgcgttcgtgcgcgaggacgacgccgtttatcacacgtactccacctatgcgcgcgggctcgacgggctgtggggatgtaccagtggctcgatcgcgcgccgcgcggacgcaacgaggccggcccgtggtggcgccgtcatgacgagtacgcacgcggctgagtgcgccggcgacgggcgggggcgggcggtgcggacgatggcgcggccgccggccggcgacgcgggccccgatccgcgagccttcggcacggcgctcgtggccgtgttcgccgttgccgtgctcgcgaccgtggcgctgcatgcgtcgatggccgcgatggggcgcgaaccgatggccggcggctggatggcttcggccgcatggctgcagccgtgcggccggggcgccggacgcgcattcgcggcgttcgccggaatgtggggcgcgatgacggtgacgatgatgctgccggtgctggcgccgatgctctggcgataccggcagcgcatcggcccgatggcgacggcgcgttccgcctggctcgtcgcagttgcgggcgccgggtacttcgcggtgtggatggcgctcggggcgctcgtgtttccggctggcatcgcgctgacggccgccgccgcacggctgccggcgcttgcccgcgcgctgccgtttgcggccggcgcggtcgtgtcggttgcgggcatgctgcaattttccgcgtggaaggcccggcggctggcgtgctgccggcatgcggcaggcgacgcacaccggtcgtcggcagttgccggtgcggcatggtggcacggcgtgcggggcgccatgcactgcggcgcctgttgcgggaacctgatggcgatcgcgctggcggccggcatgatggacctgcgcgtgatggccgccgtgacgatcgcgctcaccgccgagcgcctcgcgccgcccggcgggcgtgtcgagcggatcgccggttgcgtggcggtcggcggcggcatcgcgatgatcgcgcgcgcggccgggctgctataactcagggtaggcaggccgattcgacgcgttgtctggccttgcttcgccgtggctgcttcggctgcgtggcccgtttgcaacaggccgatgggccatattgccgcccgttgcgcgaatggctcgatgcggcggtgaaacgaaagacgatcgaaaacgaaccgaacggcgaaccgaacgattcggcccccgaacggccgaaaccggctaagccgttgttcgtgttgtgaaaattcacggcgcttcgcgtataattcgcttttgcgcccataggatttgccatgcgtctgatccaaaagcactcactttcgatgacgtgctcctcgttcccgccttctccgacgttctcccgcgcgacaccagcctcaagaccaagctgacccgcaacatctccctgaacatgccgctcgtgtccgccgcgatggacacggtcaccgaaggtcgcctcgcgatcgcgatggcccagcagggcggcgtcggtatcgtccacaagaacctcacgccggccgagcaggcccgtgaagtcgcgaaggtcaagcgtttcgaatcgggcgtcgttcgcgatccgatcacggtgccgccgcaaatgaaggtgcgcgacgtgatcgcgctgtcgcgccagcatggcatctcgggcttcccggtcgtcgaaggcccgcagctcgtcggcatcgtcacgaaccgcgacctgcgtttcgaaacgcgcctcgatgagccggtcaaatcgatcatgacgccgcgcgagcgcctcgtcacggtcaaggaaggcacgccgctcgccgaagcgaaggcgctgatgcacagccaccgcctcgagcgcgtgctggtcgtcaacgacgcgttcgaactgcgcggcctgatgaccgtcaaggacatcacgaagcagaccgagcacccggatgcgtgcaaggacgaacacggcaagctgcgcgcaggcgcggcggtcggcgtcggcccggacaacgaagagcgcgtcgagctgctggtgcaggccggcgtcgacgtgatcgtggtcgataccgcgcacggccacagcaagggcgtgctcgagcgcgttcgctgggtcaagcagaacttcccgcacgtcgaagtgatcggcggcaacatcgcgacggccgccgccgcgaaggcgctcgtcgaatacggcgcggacgcggtcaaggtcggtatcggcccgggttcgatctgcacgacgcggatcgtcgccggtgtcggcgtgccgcagatcagcgcgatcgcgaacgtcgcggaagcgctgaagggcacgggcgtgccgtgcatcgccgacggcggcgtgcgcttctcgggcgacgtgtcgaaggccctcgcggccggcgcgaacgcggtgatgatgggcagcatgctcgcgggcaccgaggaggcgccgggcgacgtgttcctgtatcagggccgccagtacaagtcgtatcgcggcatgggttcggtcggtgcgatgaaggacggcgcggcggaccgctacttccaggacaactcggcgaacatcgacaagctcgtgccggaaggcatcgaaggccgtgtcgcgtacaagggttcggtcaacgcgatcctgttccagctggtcggcggtgtgcgcgccagcatgggctactgcggctgccgcacgatcgacgagctgcacgacaaggccgaattcgtccagatcaccgcggcaggcatgcgcgagtcgcacgtgcacgacgtgcagatcacgaaggaagcgccgaactaccacgtggactgatcgccgatgaaaccgctgctgcgagccgtgctgatcatcgatgccgtgctgctgctggcgttcggcgtgctgttcgtgctgacgccctggcagtcgctcttcaacgcgctgcagctcgcgaacgtccagccggcgatgctcggccaggcgttcggcatcgcgttgctcgggctcgcgtggctcgcgtttcatgcagcgttcaacggggatctcaccgcgcccgtcgcgcgcgcggtcggccacgtgtactggctgaccggcgcgctgacgatcgtctggtcgatcggcaccggcagcggtcccgcgctcgccgccgccggcagggtgctgtcggccgtggcgggtgtcgcactgatcgtgctcggtctcggcggcgtgcggctcgcatcggccgtgcgccggcgcgaaaagcgcaggcgctcgaggcgcgcgcgccggcgtcgcgtccggacgagcctgcgatggcgcaagcgtcgtcggccgcgccgcagcgtgtcgaacccgtcgtcagccgccccgtggcgccgtcgccggccgccgcaccgtcatcggccgcatccggccaatcgtcgtcaggcaccgtcgcactcgacgagcgcccgccgatgcaggattgaccggccatgcgtcgcgcgtgctgccttccgcccgacgccgctgtccatgcttttgacgcagcgcatgatgcaaacgatgcgctgcttttcttattctcttcatcccgtccgcagccatgcacgacaaaatcctgattctcgacttcggttcgcaagtcacccaactgatcgcgcgccgcgtgcgtgaagcgcacgtctactgcgaaatccatccgaacgacgtgtccgacgacttcgtccgcgaattcgcgccgaaggcggtgatcctgtcgggcagccacgcgagcacgtacgaagaccaccagctgcgcgcgccgcaggccgtgtggatctcggcgtgccggtgctcggcatctgctacggcatgcagacgatggccgtgcagctcggcggcaaggtcgagtggagcgaccaccgcgaattcggttacgcggaaatgcgcgcgcatggccatacgcgcctgctcgacggcatcgaggatttcaagaccgacgaaggccacgggatgctgaaggtctggatgagccacggcgacaaggttgccgagctgccgccgggcttcgcgctgatggcgtcgacgccgagctgcccgatcgccggcatggccgacgaggcacgcgggtactacgcggtgcagttccacccggaagtcacgcatacggtgaagggccgccagatcatcgagcgcttcgtgctgcagatcgccggcgcgaagcccgactggatcatgaagaatcacatcgaggaagccgtcgcgaagatccgcgagcaggtcggtgacgaggaagtgattctcggcctgtcgggtggtgtcgattcgagcgtcgcagccgcgctgattcatcgcgcgatcggcgatcagttgacctgcgtgttcgtcgaccacggcctgctgcgcctcaacgaaggcaagatggtgctcgacatgttcgaaggccgcctgcatgcgaaggtcgtgcacgtcgacgcatccgagcagttcctcggccacctggccggcgtgaccgatccggaagcgaagcgcaagatcatcggccgcgagttcgtcgaggtgttccaggccgaggcgaagaagctgtcgaaggcgaagtggctcgcgcagggcacgatctacccggacgtggtcgaatcgggcggcacgaagacgaagaaggcgacgacgatcaagagccaccacaacgtcggtggcctgccggaaacgctcggcctgaagctgctcgagccgctgcgcgacctgttcaaggacgaagtgcgcgagctgggtgtcgcactcggcctgccgccggagatggtgtaccgccatccgttcccgggcccgggcctcggcgtgcggattctcggcgaagtgaagcgcgaatacgcggacctgctgcgccgcgcggacgcgatcttcatcgaggaactgcgcaacacgaccgcgaccgcgcaggatgcggctgccggcctgtgcggcgaagccgatgtcggcaagacctggtacgacctgacgagccaggcgttcgcggtgtttctgccggtcaagtcggtgggcgtgatgggcgatggccgcacgtacgactacgtgacgtcgctgcgcgccgtgcagacgaccgacttcatgaccgcacactgggcgcacctgccgtacgcgctgctcggccgcgcgtcgaaccggatcatcaacgaggtgcgcgggatcaaccgggtcgtgtacgacatctcgggcaagccgccggcgacgatcgagtgggagtgagcggtaaaaagctcctcttgaatcattggcttacgcaggaccttgcagggttttcgttgcgatccgcatggttgtaagccattgacgtagaaacgaagtttctacgaatccgagactgcccgccgcgtatgcgctgcaagtgacagtggggctggcagtagccgaatgcacgattgcgactcgataatctgccggcaacgggattcagtcgtggcagtaaaaatccttccagaatgcgggatgcggtgcgggtttgcgggcacatcgagggctcgtgattggtaacggtaaaagcggtaccaatcacgagaacaggaaacgaggctcactgaattcgcattccgcaatcctttaaatcccgtacagccctgtacaagatcaccgaccgcgacggtgtgcatgtcgcagtatctccggcgggcatatttcctttcttcgatacgattaaccgcattattgagtgaagagaaacggcggcggccgtgcgccgcgtcgcagcccttcgctgaatgcgtcgccagttggcgtaatgaagccggaatggcgaatccgaaagcgcattgttgcgctcgacagggattttgtcgttgaattggtgtcgcgtgtttctccaaaggatcgatatttttcacgcagtctgcacggttttatctttcgccacttcctataatggtcttcagcaacgtggaacgccttggttcattgcggggctgtgtcgtctccgggcgtgaccgcattgccgatgcgccatggtcaattggccgtggtatttggtggccttctactgtagttgcagcgtcgcgcgccaccgccaaaaacgctacgtcacaggaaagaaaaatggcaaacctacaaaacggcatcaatgcgtggattttcttgaacgaagacgaaccgccacaaaccaactacaacagtcccgaaagttgctatcaatcgctgatcgattgcaaggtttacgacagtgcaaattttcttggcattgctttttcgaagtcgttcccgccgcacagggttccacgatccagatcggcaacgcgtcgcattcgggtggactgaccaatcaggattatttgaattttgtactccgtgatgcgcgtcaggtgaatcctggaattaaatttctggccacgatggtgtattccggcgccaatacattggcggcggttttctcgggaggtggagatccgcaaacgcaggcggccaactttgcgaataatctggtgacatatctcaagaataatggaatgaatggcctggatatcgattgggaaggcgatgtttccgataaaatgacgcgaacgcagtttcagattctgttctctgcaattcgcgccgagttcgatcggcagccagtgaaatattatctgtcattcacgcccgcatggcccaccagttcgattgattacgctacggtcaatagccagttcgattttgtctctccgcaattctacgacggcacgccgctatcggattttcttgatgccggcatatcgccgtccaggattggctatggcgctcagttcgagccaggaaattcagctcccaatgccagtgcgcaacaggtctggagcatggtttcggaaggtttttcttccggggtacgcggtacgattatcaggatattttcgtctggcgcttcaattctggaaacttccagttcgagcaggcgcagttcatgattctcgatcaactcggaaatccgcccaccagcaacgccttcgacgacacaccgattatcagcgccgcaggtaatcccaaccttacccgaatgacgatccggtcaggcgacgtactcaacgcggttcaggccgtcaataccgggacggggccatataacaccggcacccaggaacgggaaccggaatatttaccttgttgcaacacggcggaaacagcgggactgcccaggtcatcaatattccgcttgacgatccgatcgtgtccatttccggctacacgggcgtgtggtacggctggcaatgtgttttgcaactcacgttgaccgggaaaagcggagccacttatggcccgttcggcagtatggccggctcaaccacccggaatggtttcgtacagtctgctccggccggacaaagcgtggtcggcttcagtggatctacggtgacggttccgttggcagggggcagccagaccgcaattcttgcaacgctgaatgccgttttcgcctgaggcacctgatagcgatttttcagtacctgcggcaatggttgaccaaggccatgcgactgcatggcctttttcaattcgtgtcgggagattcccatgccgttttgcgctcacatgctgcccgagtcatgaaacgtcgcgtggcacgcgtgatgcggcaatccgtcatgtgcccgacagcaatcgcctgcggccgtcgaccgattctcacgcatgcgcgcccgcgagcgagcgcaggtacatcggcactttcgccttcgccgttgcctggacacgcgtcatgagcgcgtgatcgatacgatccagcccgtaagtccgggcaatgtcctgctgcagcctgcaccacaggtggctggccatttcggcatcgaccatcgcccggtgcgcccgccccgatttcggcaatcgcagcatgtccgcgaggctcgacaggcgatgactcagcgcgtccgggtaaatgcgccgcgccacgagcatcgtgcaggcaaatgcatgctcggccgtcatgccaagcagcccgagttccgcctgccagaaccgtttgtcgaaaccggcgttgtgggcgacgaccgcgtgtttgccgacgaacgcagccgcttccttcatgactttcgataccggcggcgccgatgcgatcatctcgttcgtgatgccggtcagcgcgacgacgtccgacggtatgcgtctgcctgcattcatcaggctctggaaacgatcgacgacttgtccgtcgcggaggaggatgacggcgatttcggtcgcacgatcacccaggttcggcgaaagtccggttgtttcgaagtccagtaccgcaacggtttgcatggtcgaatcctgttgcttcacgcggtgtcgttcagagaggccgagaggttagcatttcccggcccacgacggactcgttcagcccggcaaacaaccatccgtgcggcacaagccgatccgatcgacgcctgggatcgcccgcgaatgcgtcccgattcgccgttggcctggcaggacgcacgaggcgcgacgatgcagaaggatgccggctagcggcagccctcgacccgcgcatcatgccgcaatcccgtttccgccttcgacgatccggatcgggcccgtggcgtgtcccgcaccctgcccgagactgaactcgatcagcgcctcgaaaatctcccgttgcccggctggcagcacgggcagcagcgtctcgcgccgcttgtccgcatcgaacatcgattccaccagccatcccgtcagatagagcgacgcaaggcatccgcccgcggtcgcgacgttgccgtgacacaccagcggctggtccatcacttgcagcccgactgcctgcaaaccctgccgcgcttcggggtgcgtcgtcgcgcggcgctgcggtagcagcccgagccgttcgagaatgaaggcgccgccgcagatcgacccgacaagctggcgttcgggatcgagatcgaacgacggcaggaaaccgggatcggcgagcgcggccggtacgccttccttgccgctcgaaaacaggaccgcgtcggcgcgattggcgtcggcgagcgggccgtgcgtcgggatcgccagaccctgggcggaatgcagcaccggctgcgcgcccaggatccggacgcgccagtccttgctgttgcgaccgagaatgtcccacatcaggaacaggtcgatatcggtgaaccggtcgaatgcgatgagcgcgatgtctttcaaggcggactccttatgtaatggcgcgctgccggaagcggcggcggccgtgatagagttcgcagcctatctgtccatgccgcaccatacacagcctgtatggcgaagacgatgagcacactgacgcgaaacgactggattgccgcgggcttcgacgccctcgacggagaggggtatgtgggcatttcggccgagagtctcgcgcgtcggctgaacgtgacgcgcggatcgttctatcaccacttccgcaatcgcgaggacttcgtcaggacgttgctggccgcgtgggaggacgactacaccgtgcgcatgctggcgtatgcggcggagggccacggtgccggggacacgctgttgcgctacctgcgcattgccgccgagaaacggccggggcgtgaaattgcgatccgtgcctgggcattgcacgatccgctggtcgcggaatgccagcagcgtgtcgacgcggcgcggctcgcgtttgcgatcgacacgtcgcgccggctggtgcgcacgccgggcgaggccgagatcgtcgggcaggccgtgcacttgtgcctgatcggtgggcagcagtcagggctgcggcgcgacgccgaccggttcaacggcttcatgcagcgcgctttttcaatggtcgaacgcgtgctgccgatgcgtcgcgcatgatgcgtcacctggcacgcgtaccggtgcacgcgcggcatgcggggcgcggactcggtagtacgcagccgcgttcgcatgtgccgtgcgtgtgacgtagagggcggcgcgatctcccgcgccggccagacgggtcatgcgtgtcgtggcgacgagggcgatgccgcgcgatggcgcaggtggatcagcggatacggccgtccttgtccatcgagcgccgagcgcccgcagcgctcgaagccgagccgctcatagaatcgcgctgccgattcgttctgctcgttgacgtcggtcgacaggtcgggatgacgcgtgagtgcgtcttccacgagcaggcgtccgacgcctgccccatggtgcgcgggatcgacgaacaaggcttccatgtgactgccgtcgagcagcatgaagccgatcgcatggtcggcctcgtcgacggcgagatcgagcggcgcaccgggcaggaacccgaccacttcggattcgatcgcgcgacggtcgtcgtcgctcaggaagtgatgcgtcgcgtcgaccgcgttgcgccagatatccagcacgcgtgcgccgtcggcctcggtggacttgcgaattctgatcatggtttgacctgtcttgatttgtagtttgaaggtcggcggcccgccgacaccgtcatggccgcgatcgggccgctcgcaagggatgcgggcagacggcgttgttcagggaatggccggacgccgtgcgtcgccgaggctcgctgcacgctcgatcgctcgtcgcgcgacgtcgcgaacgcccgcactcatcggcaaatcgtcgcggtcgagctcggcgagatcgaaccagcgcgcgtcgagcgcatcgtcgccggcagcaggtgtgccgcgcaaccagttgcacagcaccgcgaccatgacgaaatgttggtgcacgttgccgccggcatcgtaatcgaaggcatccagcgcggtaaagacgtcgagtgcctcgacgtcgacggtcgtctcttccacgatctcgcgcacgatcgcgctcgcaatcgattcgcctgcttcgatcttgccgccaggaaagccccagcagcccgcatcgggcggattggcgcggcgcaccagcagcacgtcgcgttcccgcaggacgacgccgatcacggcgggaacggggcgtatggaggcgatgacgccggtcggggagcggggcgaatcggacatgacggatcgatgcgtgcgcgtggtcgagggggcggccggtgacgattcaccgcgcgtcgtgcgtgcgctgctcgatcgcgcggatcacggcgaccatgtcgtccgcgccatgtccggcctgctcggtctcgccgtaaagcgcgtggcagatgtcgagcagcggcgacgcgatgttggcgccgcgcgcggattccgcgacgaggcgcgcatttttcagcacgtcggtgatcgcggcctgcaccgagaaatccgctgcgacgagtttgccgagtttcacgcgcgacacgtcgctcgccatcggtcccgcgttcagcacgtcggcgaagcgggcgagatcgataccgtggctttgcgcgaaatgcgtggcttcggtcagtccggtgaccatcgtgatgaggaacaggttcacggcgagcttcatcgtcagcgccgacggtacgtcgccgcacacgaagctgtcgcggcacagcggcttcacgagcgcgcggacggcgtcgacatcgtccggcgcgccggcgagcatcacgacgagttgaccggcttcggccggcttgcgtgaacccgacaccggcgcttcgacgtagcgccccgacgcggcggcgatttcatcggccagcgcgcgcgaatacccgggagcgttcgtgcccatgttcacgatggtgtgcccgccgacacgggtagcgaaaccgggcgtgccgcgcgcgagaacggcgtcgatcgccgcgtcgttcgcgagcatcaggatcacggtggagcaggcggcgaacacgtcgtcggcgtgctcggccacgcgtgcgccggcgtcgcgcaacgcatcgtcgctgccgtgcgaccggctccatacgacgagcggcgtgccggcccgcgcgagattgagcgccatcggcgtgcccatcacgccgaggccgatgaatccgactgcggtttgcatgttgtgactcccacggtgggtggagacgatcgtgggcgtcagtatcgcagcgtttccgcacgtctgccatgtcgtccccgcacccgcgggagccacgtcacggccgcgccgtcgtgtccgccctgtcagccatgtcggccatgtcagccaaaaacggccacggatagataccgcgggcgtggccgtcgccgaagagggcgcggatgccgtatccggctgcctcgaggccggccagcgtcaggtcgggccgcgcatcgacacgaccgccgtcgagccggatccttcggcattccgcacacgggcaatcgccgcgcagctgcgcataaccgatgcgctgcgtgcgaccgtccggccagcggagtgtcaacgtgcgtgcagcgtgatcgagtgcaatttcggtaggcgcgatcatcgcgacgtctcgtcgatttgccggatcgcgattcgcacggctttgcgtacttccggatcttgatcctccagcgcgtgggtgagcgcggccaacgtcgcgcggtcgcgcaattcaccgagcgcaagcgcggcttccttgcgcaggttgctgatcgcatgcgacagcagtgcggcgacggccggcgccgccgcagcatcgcgcagttgcccgagcgcacgcgcggcacgcaagcgcacctgccagtagtcgtcgtcgagcgcggcggcgagcgggtcgcgcgcgaccgcgacccgcaacttgccgagcgtcgtggccgcttcctcgcgcacctgccattcgcggtcgcgcagcgcggcgagcagtgcgtcgatggtggccgcatcgtcgggtgccgcgaacccgatcgcgccgaccgcggcgcgtcgcacatccgctgcggcatcggtggtcgcgatgcgcgcgagcggcggcagcgcacgggggccctgagccagccgagcaccgcgacggcttcggcgcgcacggcggcgtgttcggcatcgagtgcgcgcagcgcgggcgcgaacgcgccggggtcgcgcaactcgcgcaatccgcgcagcacggcgcggcgcacgaacgactcgggccggtcggcccatcggcacagcacggcacccgatgccgcgtccttcagttcggacaggctctgcgcggcggaggcgcgtacaccttcgtccggatcgagcaatgcgccgcacagtgcatcgacgacgtcgggctgttcccatgcaccgagcacgcgcgcagcctcgctgcgtacgtcggccgacggatcgtcgcacagtgccgcaacgaatgacggcaccagatcggattcctcgagatcggcaagctcgatcagtgcgatgcggcgcacggatgcgtcgggcgcggcgaggcggagggcgagtgcggcacgatccggatcgtgcgtgccgggcagcgaggcggtggaagagaaagcggtcatgggcaaaggatcggttcggtgaaaaagccgctgctcgcgcagcgcgatgcatgggcggcgcggcatggcggcgcgaacctggcgaacgccggcccggccgtcacgtcgtcgatgcacggcccgcgcgggcggcacgacgacgaccggccgcgcgcgcgctcagcgcagcaggtaagggatgtcgaccttgaccgcgccggtcgggcagtcgcgctcgcacggcatgcagtaccagcattcgtcgaactgcatgtaggccttgcccttggtcacgtcgatcgcgagcaggtcgagcgggcacacgtcgacgcagacggtgcagcccttgtcggcaatgcagcgttcctcgtcgatcgtcacgggcgcgctgctgcgcaggaagatgtcgtgcggggtatggggcacggtagggctcctcagagggcggccgcgagcgcggccggttcgcggatgcgcagattcgtgtaggcgccgcgatcgtcgtcggcgagcggcacgacgtacggttcgaccgggcgcttctcgctgcgcatcgcgccttcggcgtccttgcgcagccaggtgtggcagaaccattcggcgtcgttgcgatgcggaaagtcgacgcgatggtggtacagccccagcggctctcggtgcggaacagcgacgcgcgcgcggccatttccgcgcagtcgcggatcgcgcgcacctcggcggcgcgcatcagttcgtgcggatggcttgcctttatctcttcgatatcctcggtaatggcatcgaagcgctgcagcccgatttccattttgcgtgtcaccttcggcggttgcagatagtcgttcaccatgcggcgcagcttgtattcgacctgcgccggtgccaggccgcgctcgcgcagcagcgggcaagcacgcgcttgcgttcggcggcgacctgttcgtcgttcaccggcgcatgctctcggccggccacgtagtcggccgcgttctgcccggcaaaccagccgtacgtaaatgcgccgagcatgtagttgtgcgggacggccgccatgtcgccggccgcgtagaggccgggcacggtcgtctccgcgcgtgcgttcacgtacacgccggacgcgctgtggccgctgcagaaaccgatctcggagatgtgcatctcgaccatctggctgcggtagtcggtgccgcgccccgcatggaagcggccgcggctcggccgctcgttcgtatgcaggatctgctcgatggtctggatcgtttcctccgcgagatgatcgagcttgaggaacacggggccgttgccgctttgcagttcctggtagaactcccacatcatctggccgctccagtagtcgcattcgatgaagcgttcgcccttgccgttcgcggtgaaaccgccgagcgggccggtcacgtacgcgcacgcggggccgttgtagtccttgatcagcggattgatctggaagcattcgagattcgcgagcgcggcaccggcgtgataggccattgcgtagccgtcgcccgcgttggtcgggttctcgtacgtacccatcaggtagcccgaggccggcaggccgaggcggccggccgcgccgcagcagagaatcacggccttcgcgcggatcacgtggaactcggccgtgcggcagtcgaagccgagtacgccgctcgcgcggccctgtgcgtcggtcagcacgcgcgtcgcgacgatccggttcgtgatcgcgatgcgcgcgcgcttcagttgccggtacagcaccttcttgatgtcgtgtccttccggcatcggcagcacgtacgaacccatgtgatggaccttcttcaccgcgtagtcgccggtgccgtccttctcgaacttcacgccccagcggtcgagctgctcgatcgtcgcgaagctgtgtgtcgcatacgcgtacacggcttcctggtcgacgatcccgtcgttggcgatcgtgatctcgcgcgtgtattgctcgggcgtcgcatgcccgggaatcaccgcgttgttcaggccgtccatccccatcgagatcgcgccgctgcgtttcacgttggctttttcgagcagcagcacgcgcagggacgggtcgcgctccttcgccttgatcgccgccatcgggccggccgtgccgccgccgaccacgacgatgtcgtattcgagcacatgggtagtcatcgttgtttccttgcaggtttgtgcggtttttgccggtcgatgcgcagccggtactggaaggcatcgccgcggaagtacaggtattcgtagtcgatcggtgcacccgacgcgtcatgcgtgaggcgctcgatgcgcagcacggggctgctttcctcgacgtgcagcgcatcgacgatctcgtcgtcggcgaggatcgcgtcgatcgacacgtcggcatggccgagcggaatgccgcagtcgttttccagcacgaggaagatgtcgcgggtcgcgagatcggcacccgcgaggcgcttgccgagtgcctcgggcacccaggtctgttcgagcgacacgggctcgcgattcagcagccgcacgcggtggatctcgacgagcggcgcgccttccggcacgttcagcttcgttgcgagatggcggtcggccttgacggtgcggacgctgcgcacctggttgacgatctcgtagcccatcgacgacatcgcctcggcgaagccctgcagcgacgtcacgttctggaatgccttcggtttcgacacgaaggtgcccttgccgtgcagcttgaacagcagtccttccttctgcagatcgccgagcgcctggcgcaccgtgatccggctgacgccgaacgccgcgcagagttcgtgctcggaaggcatccggctgtgcggcgcataggtgccgtcgaggatgcgcgcgcgcagcgtgtccttgatctgcacgtagagcggggccgcggacagcggcacgacgttgggtgaggtcatcgatcaacttgttatgacaagatcgctcgagtgtagtcagcgcgatcgcgcgtcccaaccaacgatttctgatttcgactttccgattccggaaaagcacggcggtaggggcggaccggacggacgatccggcgtgaggtgtcgatccgatccacccatgacgggcgaagttgggcggcggacaatcaaggaaattcgcgggcgcctgtgccgcgcgtgtcgatttcccgatgcgtcgcccgtcgtatccatgtcgaccgggcattgcaccttgcgggtagcgcccgggtaccgaggagtgccgtaacgaaaggagacatcccatgccggattcccgataccgctgggtcatcgtcgccgcaggcggcttgatgggctgcatcgccatcggcgcgatgttttcgctgcccgttttcctgcgcgcgatcgcgcgcgacaccggctggtcgatgaccggcatttccggcgcgatgacgctcggcttcatcgcgatggctttcgcgagcatggggtggggcagcctgtcggaccgcgtcggcacgcgcccggtcgtcatgacgggtgccgtcctgctgtcggcaagcctggcgctggcgagccgcgcgccgtcgctgctcgcgttccagctgactttcggcctcgccgtcggcggtgcgacggccgcgatattcgcgccgatgatggcatgcgtgacgggctggttcgacacgcaccgcagcctggcggtgtcgctcgtgtcggccggcatgggaatggcgccgatgacgatggccccgctggccgcgtggctcgtgtcggtgcgcgactggcgcacgtcgatgctgctgattgcggcgctggcggccgtcgtgatgattccggtgtcgctgctggtgcgccgggcgcccgcgctcgacggcgcgcatgcggccccggcggcctccgcggctcccgcgccggccggtgaccctgcggcgatgtcggtcgcgcacgcgctgcgttcgccgcagttcatcgtgctgctgctgaccaacttcttctgttgcgcgacgcattccggcccgatcttccatacggtcagctacgcggtgacttgcgggattccgttgatcgtcgcggtgtcgatctacagcgtcgaagggctcgccggcatgggcggccggatcgcgttcgggatcctgggtgaccgcatcggcgcgaagcgcacgctggtggccgggctgtttgcgcaggcgctcggcgcgctcgggtacgacttcgtgcgcacgctcgacgggttctacgcggtcgcgaccttgttcggcttcatctatgcgggcgtgatgccgctgtattcggtgctcgcgcgcgagaacttcccgctgcggatgatgggcaccgtgatcggtggctgcgcgatggccggcagcctcgggatggccgcgggccccgtggccggcggcctgatcgtcgatacgttcggcagctatggctggttgtacgtcggttcgttcgcgatcggcgtcggcgcgttcctgatggcgatgatgttccgcccgttcgcgaaagcgcggccggaaacggtggccgcgtgacccggcggcggaaacacggcggcctgaatttcaccgtatcggcgcggctcggccccgcgctgccactgacaaaaacagggccggcattgcgtccgttcgcgggtgtctggacagcccgcagcccgctgcggcgcagcagcgcggcaaatgatgccgatcggcacgcatgcgccgcgattcggcccctaaaaatgcaatatcgagcatatattcgaagggcctgtcatacccgcgtcaccctgctagaattcggcctgccgcattgttccgattgactgatgagattgcttgacgccctggtcgaacaacgtattgccgccgccgcgcggggcgagttcgacgatttgccgggtaccggcgcgccgcaggcgctggatgacgacctgctcgtgcccgaggaggtgcgggtggccaaccgtatcctgaagaatgcgggcttcgtgccgccggccgtcgagcaattgcgcgcgctgcgcaacctgcacgacgaagtgcaggcggtcagcgaccgtgccgcgcggtgccggctgcaggcgaagatcctcgcgctcgacatggcgctcgaatcgctgcgcggcggcccgatggtgatgccgcgcgattactgccggcgcatcgcggagcgcctgtgcgagcgcgggctcgacgaagcgtccgccgaagcggggccgatgtgacgtccgacgcgctgcacgacgcagcccgcccggcagacaccccggcggccgaacccgccgccgattccccgttcccgaagctgcgcccgtatcggcgcgcgacctgcatttcatgcgtctcgcgcaggccgccgccgaagaggcgcgcgcggccggcgaagtgccggtcggtgcggtgctcgtgcgcggcgacgaagtgatcgcgcgcggcttcaaccatccgatcggcgggcacgacccgtcggcccatgcggaaatggccgcgctgcgcatggccgcgcagcatctgcagaattaccggatgcccggctgcgagctgtacgtgacgctcgaaccgtgcctgatgtgcgcgggcgcgatcatgcatgcgcgtatcgcgcgagtcgtctacggcgccgccgatccgaagacgggcgcctgcggcagcgtgatcgacgcgttcgcgaatccgcagctgaaccaccataccgaagtgaccggcggtgtgctcgccgacgagtgcggcgccgcgctgaagtcgttcttcgccgagcgccgtcgcgcgctgcgcgaagcgcggctggcccgcgacgccgaatccggcgcgtcataggcgcgcccgccgccccgacccgagccgggcgtgcacggcttcgtgaaccggagacggttcagaccctctaagcaggtttgacgacccgacacctttcgccatgtccttccagcccgccgcgtcctataccatccggctgcttgcgccgtccggctatccgcacgaccccgacgcgatcaaccgcgcgctcgagcgcctcagcaccgcgcagcaccgcatcgagaacatcgaggcgacgcagcggcgcttccagcggttcggcggcaccgacggcgagcgggcaggcgacctgaaccgtcttgccgatcccgagcggccgctgccggacatcgcgctggcggtgcgcggcggctacggcgccgcgcgcatcctgcacgggctcgactatcgcgggctcgaacgcaggctgcgcgaccagccggtcgcgctcgtcggccacagcgacttcacggcactccagctcgcgctgtatgcgaaggcacgcatcaagacgttcggcggcccgatgctgtccgccgatttcggcgcggaaacgccgagcgacttcacgatgcagcacttctggcagacgctgacgcagccgagcacgacgatcgtcgccgacgcgccgcaggtgcagagcgtgaacgtgacgggcacgctgtggggcggcaacctcgcgatcctctcgtcgctcgtcggcacgccgtacatgcccgacatcgaaggcggcatcctgttcatcgaggacgtcaacgagcagccgttccggatcgagcggatgatctatcaactgcacctgtcggggctgctcgcgcgccagcaggcgctggtgctcggccagttcaccggtgcgcggccgttcgagtacgacaacggctacgacatgcaggcgatgatcgagcaggtgcgcgcggtggtcgggattccggtcgtcacggggctccagttcggccacgtgcccgacctgctgacgctgccgttcggcgcgcacgcacagctggtcgcgaatgcgcacggtttccggctcacgctgtccgactatccgcacctcggctgagatgggtgcgatcgatcgaaaggcgggtttcccgccttttctttaggtaagcacgcaactaacgatcaagtttttcgtcgacattcgcagcacggtcgccgaattttgcaccagttttgtcaacaaaaagccgggagggtatacgacgagaagggcctctgccgtacgtctcggccttgtcgtgcatggattcgacgcatcatgcaccgaacggggtcgcgtcgatgcacgccgattgtgcgcaatgccggaaaagaattgttgacaatctttatgtccgccctaggatgaggatcatcacacgatgccgatcatgaacgagcccgaagcccacctgtccggtgcagccagccccgaagcgatcgccgagcggattcgcacggcgatcctcgagcatcggctcgcgcctggttcgaagctgacggaggcgcagctctgcgacgtattcggcgtgaagcgcgggacgatccgccaggcgcttgcgcagctcgcgaccgacaagctcgtcgagctcgagccgaaccgcggcgcgttcgtcgcgagcccgacgctgcaggacgtgcacgaggtgttcgagatgcgccggatcatcgagctcgccgtggtcgagcggctcgcgaccgggcccggcgcgaagcggctgaagggcgtcgccgcgctgatcgacaaggaacgcaaggcgttcgagcggcacgacttcgcggcgtggatccggctgtcgggcgaattccacacggcgctcgccacgctgatgggcaatgcgacgctcagcgagtgcctcgaagggctcgtcgcacgctcgacgctgatgtcggcgctgtacgaatcgcacgggcgcagcccgtgctcgtgcgacgaccacgaagagatcctcgccgcgctggaggcgggcgatccgaagcgggcggtgacgctgatggcgcaccacctgcagcatgtcgaactgaagatgctggaccggcccgcacaagggcaggtcgatttgcgcgaagtgttcggcggcgcctgagcggcgacgcgaacccggccgcgcgccacataacgagcgaaatgcaggcccgcggtatttgccgcgggccgctggtccgactccgggcgtcgatccggagcgatatcgatgacggtggagcggccatccggtcgcgtcaaggagaagtcatggctcagttcagtgtggcgcacgatagcgcctatccggcggaagagggcggcgagggcggcgacccgacgctgccgaagggttacagcgaacgtctgtataacgaagatttggcacccctgaaaaaccagacatggggttcgtacaatatcttcgcgttctggatgtcggatgtgcacagcgtgggcggctacgtgttcgcgggcagcctgttcgcgctcgggctgacgagctggcaggtgctgatcgcgctgatcgtcgggatcagcctcgtgaacgtgctgtgcaacctgatcgcacggccgagccagcagatcggcgtgccgtacccggtcgcgtgccgcgcgacgttcggcgtgctcggtgcgaacgtgccggccgtgattcgcgggctgatcgcgatcgcgtggtacggcatccagacctatctcgcgtcgagcgcgctcgtgatcgtcgtgctgaaattcttcccgcaatggctgccttacgcggacgtgcatcgctacggcttcctcgggttgtcggcggtgggctgggccggcttcatgctgctgtgggtgctccaggcgttcgtgttctggaacgggatggagacgatcaagaagttcatcgacttcgcggggccggccgtctacgtcgtgatgttcatcctcgccggctacatggtgtggcgcgcgggctggcgcaacatcggcatcaacctcggcggcgtcaagtatcacggcgcggaagtgattccggtgatgatcacggccgtgtcgctggtcgtgtcgtacttctccgggccgatgctgaacttcggcgatttctcgcgctactgccgctcgttcggcgacgtgaagcgcggcaatttctggggctgccggtcaacttcctcgcgttctcgctcgtcacggtgatcacgacggcagcgaccttgcccgtgttcggcgaactcatcaccgacccggtcgagacggtcggccgcatcgaccatccgaccgcggtgatcctcggcgcgctgacgttcacgatcgcgacgatcggcatcaacatcgtcgcgaacttcgtgtcgcccgcgttcgacttctcgaacgtcgcgccgcgcctgatcagctggcgcgcgggagggatgctcgcggccgtcgcgtcgatcttcatcacgccgtggaacctgttcaacaacccggccgtgatccactacacgctcgacgtgctcggcgcgttcatcggcccgctgtacggcgtgctgattgcggacttctacctcgtcaagcgcggccggctcgtgcgcgacgacctgtacacgatgtcggaaagcgggacgtactggtacacgggcggcgtgaaccgccgcgcgctcgtcgcgctgttgccggccgcggtgatcgcgatcgtgtgcgtgatggtgccgggctggcagggcgtcgcgaacttctcgtggttcatcggcgcggggctcggcttcgtgttctaccggctgctcgtgaacacgaaggcctgaggagcgtgcgatgaagatccggctgatcaatccgaatacgacgcagcggatgaccgacgcgatgggccgctgcgcgcgcgaggtcgcggccgccggcacggagatcgtggcggtgagcccgccgatggggccgccgtcgatcgaagggtattacgacgaggcgctcgcgacaccggggctgcttgccgagatcgcgcaaggcgagcgcgacggctgcgacgcatacgtgatcgcgtgcttcggcgatccgggcctgtacgcggcgcgcgaactcgcgcgcgggccggtgatcggcattgccgaggccgcgatgcatgcggcgagcgtgctcgcgcccggcttctcggtcgtcacgacgctcgcgcgcacctgcgggatggcgtggcacctcgcggagcgctacggaatgaagcggttctgccgcaacgtgcgcgcgaccgacgtcgccgtgctcgagctcgaccggccgggctcggccgcgcggcggatcatcgtcgacgaatgccggcgcgcgctcgacgaggacggtgccgacgcgatcgtgctcggctgcgcggggatggccgagttcgcgcacgaaatcgagcagcagatcggcgcgccggtggtcgagggcgtcacggcggcggtcaagtgggccgaggcgctcgtcgcgctgcgcctcgcgacggcgaagcgcggcgattacgcgcggccgctgcccaagcgctacgacggcgcgttcgcccgcttcagcccgccgggcggggaggaggcagagccggccccgaatttgccgcaaccgcacatacacaccgtctgacacgcactatctgcgccgctgtatgggcgcgtatgggcgttttcgctacactgggccgtcatcgcatcggcttgcgcagccggcctccggcacccgcgcggtcgatgcgaacccattatttcagcgagctttcgccgcacctcgaaccatgtcactcgatcccaactatcctcgcgacctgatcggctacggccgccatcccgtgcaggcgaactggccggggcgcgcccgcgtcgccgtgcaattcgtgctgaactacgaagagggcggcgagaactgcgtgctgcacggcgatccgggctccgagcagttcctgtccgaaatcgtcggcgcggccgcgtatcccgaccgccacatgagcatggagtcgatctacgaatacggttcgcgggccggcgtgtggcgcatcctgcgcgaattcgagaagcgcgggatgccgctgacggtattcggcgtcggcatggcgatcgaacgccacccggagctcgcacgcgcgttcgtcgagctgggccatgaaatcgcgtgccacggctggcgctggatccactaccagagcatgacgccggaactcgaggccgagcacatgcgcctcgggatggaagcgatcgagcgcgtgacgggcgagcgcccgctcggctggtacaccggccgcgacagccccaacacgcaccgtctcgtcgcggaatacggcggtttcctgtacgactccgacaactacggcgacgatcttccgttctggatggacgtcgaagtgtcgggcggcaagacgtcgccgcagctgatcgtgccgtacacgctcgacacgaacgacatgcgcttcgcgacgccgcagggcttcaacaccggcgatcacttcttcgactacctgcgcgacgcgttcgacgtgctgtacgcggagggcgacgaagcgccgaagatgctgtcgatcggcatgcactgccggctgctcggccggccgggccgtttccgcgggctgcagcgtttcctcgatcacatcgagaagcacgatcgcgtatgggtgacgcgccgtgtcgatatcgcgcgtcactggcgtgaacatcatccgtatcagcccaatcatcgaaacgaagggaaagcatgaaggcgatgcgctacacgttggatcaactgaacacgatggcgccgagcgcatttgtcgcggcgttgtcggggatcttcgaacattcgccgtgggtggccgaagtcgccgccggcgagcggccgttcgcgagcatcgacgcgctgcacaagacgatgtcgggtgccgtggaatcgggcggcgaagcgcgccagctcgcgctgatcaacgcccacccggaactggccggcaaggccgccgtgcgcggcgagctgacggccgagtcgacgcgcgagcagagcggcgcgggcctcgaccagtgcacgcaggaagagttcgacaagctgctgacgttgaaccgcacgtatcgcgagaagttcggcttcccgtttatcctcgcggtgcgcggttatgaccggcacggcatcatcgcgaacttcgaatcgcgcgtgaatcattcgcgcaccgaggaattgcgcgcgagcctcgaccagatctaccggatcgcgcgctttcgcctcgacgacctgatcgacgcctgacaccgcagtacggcccgctgcgtcgcagcggccggatcgcctcactgaaacaaggaaacatcatggctgttccgcttctcgatcccaacgcacccgaattcacgcggcgctacgtgaatcttgccgacccgcgtctcggtgcgcaggcgctcgaggccagcgacgatttcttcgcgccgaaggaccggatgctgaaccccgagccggccgtcttcattcccggcaagtacgacgaccacggcaagtggatggacggctgggaaacgcgccgcaagcgcacgacgggctacgactggtgcatcgtcaagctcgcgcgcccgggcgtgatcaagggcttcgacatcgacacgagccacttcaccggcaacttcccgccggccgcgtcgatcgaggccgcgttcgtggccgacggcgcgccgacgcaggcgaccgagtgggtcgagatcgtgccgtcgacgacgctgcagggcaacagccatcactatgtcgacgcgagcgacgcgcgtgcgttcacgcacctgcgcgtgaacatctacccggacggcggcattgcacgcctgcgcgtgtacgggcagccgcagctcgactgggccggcgcgagcgcgaccgagcagttcgatctcgcggcgatggaaaacggcggttacgtggtggccgcgaacaaccagcacttcggcgtcgcgtcgaacctgctgctgccgggtcgcggcgtgaacatgggcgacggctgggaaacccgccgccgccgcgaaccgggcaacgactgggcgatcatcgcgctcgcgcagccgggcgtgatccgcaagatcgaagtcgatactgccttcttcaagggcaactatccggatcgctgctcgatccaggccgcgtacgtgtcgggcggcacggacagctcgctgatcacgcagtcgatgttctggccggtgctgctcggcgaacagaagctgcagatggacaagcagcactacttcgaacaggacatcgcgtcgctcggccccgtcacgcacgtgcgactgaacatcattccggacggcggcgtgtcgcgcctgcgtctgtggggacgctcgacaaatgaagacgcttgtcatcgaaccgctgaccagggaagcgttcgcgccgttcggcgacgtgatcgaaacggaaggggcaaggcagatcccgatcaacctcggcacgacgatccgtttccacgatctcgcgaaagtcgacgtgaccgatgaagacggccgcacgctcgtcaacctgttccgcggccagccgcgcacgctgccgttcgaagtgaagatgctcgaacggcacccgctcggcagccaggcgttcgtgccgctgaacgaccagccgtatctcgtcgtcgtggcgcccgcgggcgatctcgatccggcaaagatccgcgcgttcgtgacgagcgggtggcagggcgtcaactatgcgaagggcgtgtggcatcacccgctgatcgcgctcggcggcgtcagcgacttcatcgtcgtcgatcgcggcggcgacggcctgaacctgaacgagcaggacctgcaggaatcgctgtggctcaccgacgaggcgctgcacgcgctgacggcctgagtcgtcgctggcggttccgccattgccggtcgaaaacccgcgcacgttgcgcgggtttttcatggtgccgccgtttcgacgcaattcaggtcgccgcggtcttgcgcgcgtcgcgcggaccgtgggcgcggcgccggtccgcgaccggcgcatgctcggcgatcagcccggcggcccagtcgatgaagacgcgcagcttcgcgctgacgtgccggttcggcgggaacgcgacgtacatcggcatcggttcgagctgccatccctcgaacagcggcaccaggtcgccacgggcgcgatgcgcgccggccatgtaatcgggcagccacagaatgcccagcccggcgaggccggcctcgaggtacgcattgccgtcgtcgaccgcgagcacgtagcgtccgcgcacggtgatccgctcgtcgtcgcatgccatcgcaaacggcaacgccttgcccgtgcgcgcccacaggaacccgacgatccggtgatgcgagtcctccagctcgtccggatgagccggcgtgccggcacgcgcgagataggccggcgacgcgtacacgccgagccgcaggtcgccgacatgccgcgcgaccagcgagcggtcggtcggctcgccgccgcgcacgacgcagtcgacgttctcgccgatcacgtccaccacgcggtcgctcacgcccatgtcgagctggatgtccggatagcgcgcatggaacgcgggcagcgcggggatcaggatcaggcgcgcgaacgggctcggcacgtccacgcgcagccgcccgcgggcgtcgcggacgccgcggacaggctggtttcggcatcgtccatgtcggccagcagccgcacgacgcggtcgtagtacgcggcgccgtccgcggtgacgacgaccttgcgcgtcgtgcggttgaacagcttcacgcgcagccgtgcctcgagctgctgcacgagttgcgtgacggtggtgcggctcatgtgcagtgtctcggcggccttcgtgaagctgccggcttccaccacgcgggcgaacgcctgcattgcgtcgaatcggtccatcgggtcagggctccgcgtcggtcgggaattgtttggggcgtgcaaacagtgttggacagggttgccggtttattcgccgtgccaccgtccttaaagtgccttcatcgttgatgccggggcggtttcgccccacaaaccgaaggaggtgctgaatggtaaagcgtagcgtggtttttccgcccggtcggcaggcactgtacgagcgcaaccgctattcgccggcgctgcgctcgaatggcttcctgttcgtgtccgggcaggtcggcagccgcgaggacggctcgcccgaaccggaactgggcgtgcaggtccgccgcgcgttcgacaacctgaacgcggtactgcgcgcggccggctgcacgttcgacgacgtcgtcgacgtgacggtgttcctcgtcgatcccgaagcgacgttcgagcggatctgggagatcgtccccgagtactggggcgacgcgcctcatccgacgctgactgccgtcggcgtgacctggttgtacggcttccagttcgagatcaaggcgatcgcgcggctgccggagacggtcgacgggtgagccatgcccgacacggagcccgcgcgtcacggcgcgacgggcacctcctgttcgtacgcgcgatgcagcagggcgacgaacgacgacgcgtccggcagcgtcgccgtgccgaagcggtgcacggcgacaccgggcgtccacgagttcatcacgacggcgccggccatcgacggcaggtcggccggcgtcagttcgcgatcgtgctgcgcgacgcccaggcgcgccagctgccggcgcacgatgcgcatcgtgactccgccgagcatgctggccaccggccacacgaccgcgtcgcccgtccagaacgccaggttccagatcgagccttcgctgatgcgtccgtggcgatcgacgaatgccgcatcgtcgaaaccctgcgcgatcgcgcggcgcaggaagtgcgtcttggcgacttcgccgacgtgcttgatctccggcagcacgcgctcgtggtcgaacaacgcgagatcgagcgggcccgccggccccgacgacggcgcggcggtgcgcaccagcacgtcgagcgcttcgtcgtcgcgcggcgcgacgaattcacccgtcgtcgcatgcacggtcgccgtcagcgacagcgccgacggcgcgcgctcgagcgcagcgcgcaggagcgcgcgaatccgggtgtcgggcagcgcctggccgaacagtgcgttcgacgcatcgcgcagccgcgcgagatgcaggtcgaggccgcgtacgcggccgtcgcgcacctgcatcgcggtgaaatgcgcgtggcccgcgaatgcgagcggcgcgagcgcgtccggggtggcgggactgccgttgagctgaacgacggacgggaacggggcaacggtcatcggcggatctccggttcggtcgcgagcgcggggcggctcgcggcatcgtcaagaaagcctattgtttgcggattgatggcatcttgaaaaacgagtagttttggaacggtcatcaaatccggtttgaagatcgatggaacgcatgtggcccggtacgcgcgcgctgaggacgttcgatgcggcggcgcggcacctgaatttctcgcgggcggccgacgaggtcgggctgacgccggcggcggtcagtcatcagatcaaggaaatcgagacgcagctcgacgtcgcactgttcgtccgcacgagccgcagcatccggctgacgccggccggtgtcgtgctggccgccgcggccgccgatgcgctggcgggcctgcagcgcgcgacggcccgggcgcggcgcatcgcgcgcgagcagacggagttgcgcgtgtcggtcggcgcgcgtttcgcgacgcactggctgctgccgcgcctgccgcgtttcagggccgcgcatccggcgttcgagctgacgttcgacatcaccgaccggttgcgcgatttcgacgatgacgacgtcgatgtcgcgatccgcttcggcaccgggcgctatcgcgacgcgtgcgcgcagcgcctgttcgatacgtcggtcgtcgcggtctgcggcccggcactgctgtcggccgggccgccgttgcgcaagccgcgcgatctgctgcgccatacgctctgccaggtcgactgcgaagtcgacggcgtgacctggccgcgctggtcggcgtggatggccgcggccggcatcgacggtttcgacgacagccggtgcgtgtcgtttccggattcgagccacgtcgtgcaggccgtgacggacggcacggcggtcggtcttgcggaaccgcacatgatcgcgcgcgatctcgcggaagggcgcgtcgtgcagctgttcgacgtgagcgtcggggtggcgccgggccttgcgtatcacgtcgtgtatcccgaacgcacgcaggacgatccgcgcatcgtcgcactgcgcggctggctcgcggacgaggtcgcgacgatgcgcgcgtagcggtagcagcggcggcgcatgctatcgtgcccgcatctccaccgcacgatgcccggttccgggcgtgttcttccgatgagtcaacctgaaaacgacctcgcgatcctgctgcgcacgatgcagcccgaactgcatccgggcgcgttcgccttcgtgtcgctgccggccgatgcagacgtatcgttatccgaagtcattgcgacgttccgcgaagcggaagggctgacggtcgtggtcgacgaggaaacggctgcacgtcgcggctggccggtgctgttccgctcggcctggatcacgctgaccgtgcattccgacctggcggccgtcggcctcacggcggcgttcgcgcgggcactcggcgcggccggcatcagctgcaacgtgatggcggccgcgtatcacgatcacattttcgtgccgttcgacgacggcccgcgcgcgctcgatgcgctcgtcgcgctccagcgcgacgcgacgcgcggctgacgcgcgaagggcatccgggacgcgccaaagaacgggcccgtcaccgggcccgagaacggagaggattgcaccgggcactcacgcccggcgcacggcggcttacttgttcgcgccaccctcgaaccaggcggcgagcttcgtccgctcgtcgtcggtcatgtgcgtgacgttgccgatcggcatcgccttcaggcgcaccgcctgttcgtagatgcgctgtgcgttcttcgacacttcgtccggcgtgtcgaacatcacgcccgcgggcgcgctgcccatcagcgtcggcttcgacgagtggcactcgacgcagcgttgctgcaggatcggcaggatgtcgttgatcacgatcttcggtgcgttggccgcttgcgcttccggcgcgaccggcttcggcatcgtccagaccagtgcacccgacagcagtgcgacgccgccgatcggcaggtaccacagctgcttgccgcggtgacgcatcacgaagaactggcggatcagcgcgccggccagcatgatcagcacgagcacgacccagttgaacttgttcgtgtaggtcatcgcgtagtggttcgacagcatcgcgaacacgaccggcagcgtgaagtacgtgttgtgcactgagcgctgcttgccgcgcttgccgtagatcgggttcggctcttcgcccttgagcatcttgtcgaccatcttgcgctggccggggatgatcacgaagaacacgttcgccgacatgatcgtggcgagcatcgcgccgacgatcaggtaggcggcacggcccgcgaagatatggcacgcgaggtaggcggcggcgaccacgtagatgccgacgcagatgccgagcacgcggtcgttggtgccgaggatgcggcacagcgagtcgtagacgatccagccggccgcgaggaagccgagtgcggacgcgacggcgaccaccgggcccatgtcgagcacgctcttgtcgatcaggtaggtgttcggtgcgagcaggtacagcacgaagaacagcgagaagcccgacagccaggtcgtgtacgacggccacttcgaccagtgcaggtcatccggcatttccggcggcgcgaccgtgtatttctgcatgttgtagaaaccgccgccgtggacatgccacagctcgccgaacacgccgcgcttgcgctggttcgggtcggtcggcggtttcaggctgttgtcgagcgcgacgaaatagaacgactcgccgatccacgcaatggcgacgatgacgtgcagccatcgcagcgcgaggttcagccagtcggtgatgaagccttccatgaaactcctccagactcaaatcgtttgtttgatgcgggcgctgattcgaatgtcagctgccgcgataggtgctgtacgaccacggcgacacgagcagcggcacgtggtagtgcgaagcggtgtcggcgatgccgaagcgcagcacgacgcggtcgacgaagcggggttcgggcaccttcacgccgagcgacgcgaagtagtcgccggcgtggaacacgagttcgtattcgccggcggcgagcgcggcgccttcgagcaggggttcgtcgcagcggccgtcgctattggtcagcacggtcttgagcgcgcggcgcgattcgccgtccagcgcgtagaggtccaccttgattgccgcgccgggacggccgtgcgccgtatcgagtacgtgggtagtgagctttcccattcgttgtgtccttatgtgaatgcggggttcggcggcgactcgatccattgactgtgcggcggatcgaggctccacgtcacgtggctacatacccgtcggcgagattgaagcgagcgccgtgcaggcattgtaaaaggttccccgcgcaaatacgggcgcgatatcaaagataatgcgccgcgcatgagcggctgtcgacggtatgccggataccgcttccggcgggcttttcgggtgtttccggcctttcgccgggcggtgcgcggcgtaccatatcgaaaccgtgaagcgcggtattccggatcgcgcattgtgtgcggcgcgtgcttgggcgatcctcccgccgtgcgcgtcggcctgtggcccgcgcgtaccccgaagacggcgagcacgccgggtaaccgggccagggcgttcgaacggacgcaggcaccggagcgtgccgcgattcagcgttcgaacggctgtgtgaccgcctccaggatcagcgcctggaggcagaccgacgcggagaacgcatgaacctcgagcagcacgctggcgcacgcgcgccgaacccttcctcatcccgcccgaaaaccctgctggtcaagcacgccgacgtgctcgtgaccatggacgacacgcgccgcgagctgcgcgacgccgggctctacatcgaagacaaccggatcgtcgcggtcggcccgagcgccgagctgcccgacacggccgacgaagtgctcgacctgcgcggccacctcgtgatcccggggctcgtgaacacgcaccaccacatgtaccagagcctgacgcgcgcggtgccggccgcgcagaatgccgaactgttcggctggctcacgaacctgtaccggatctgggcgcacctgacgcccgagatgatcgaggtgtcgacgctcaccgcgatggccgagctgttgcagtcgggctgcacgacgtcgagcgaccacctgtacatctacccgaacggcagccgcctcgacgacagcatcggcgccgcgcagcggatcggcatgcgctttcacgcgagccgcggctcgatgagcgtcggccagcgcgacggcgggctgccgcccgattcggtcgtcgagcgcgagcccgagatcctgcgcgacacgcagcgcctgatcgagacctatcacgacgaaggccgctacgcgatgctgcgcgtggtggtcgcgccgtgctcgccgttctcggtgagccgcgagctgatgcgcgacgcggccgtgctggcgcgcgaatacggcgtgtcgctgcacacgcacctcgcggagaacgtcaacgatatcgcgtatagccgcgagaagttcgggatgacgccggccgaatatgcggaagatctcggctgggtcggccacgacgtgtggcacgcgcactgcgtgcagctcgacgatgcgggcatcggcctgttcgcgcgcaccggcacgggcgtcgcgcactgtccgtgctcgaacatgcggctcgcgtcgggcatcgcgccggtgaagaagatgcgtctcgcgggcgtgccggtcggccttggcgtcgacggctccgcgtcgaacgacggcgcgcagatggtcgcggaggtgcggcaggcgctgctgctgcaacgggtcggtttcgggcccgatgcaatgaccgcgcgcgaagcgctcgagatcgcgacgctcggcggcgcgaaggtgctgaaccgcgacgatatcggcgcgctgaagcccggcatggccgccgacttcgccgcattcgacctgcgccagccgctgttcgcgggcgcgctgcacgatccggtcgcggcgctggtgttctgcgcgccgtcgcagacagcgtacacggtggtgaacgggaaggtggtggtgcgggaggggcggctggcgacgctcgatctgccgcccgtcatcgcgcggcataacgcgctggcgcgggcactcgtggaggcgtcgcgctgatgcactgagctggagagtgcgccgcgcgctgcacgtcgggcgcgtggcgcccgaggccgggatccgtcacgcccggccgcacgaggccgcttcgggccacaccgggccacaccgcagcggcgtggccggcgcgcgcgtcgtgcgcgcttacgcttcgatcagcgtgcgggtggcttcggcgacgaggctgcgcagccagcgcacttcgtcggagtagtggcagcgctcgtgccacagctggtagtactgcatcggcgggaagtcgagcggtgccggcacgaccgacagcggcaggaacttcgcgtagtgatcggcgaacaggcgcgttgtcgtgaagatcaggtcggacttcacgagcacgtacggtgcgaggttgaagtacggcagcgtgacgaccacgtggcgcttgagccgttcgcgcgcgagatgcacgtcgatcgcgccgcgctggccgaccgagtacggcgtcggcgcgagatgcggcgcgttcaggtactggtcgagcgtgagcccgccacgcttcgcgaacgggtgcgtgttgctcatcaggcagacgatttcgtcgacgaacaggttcgacaggtgcagctgctcgggcggttcgggccagttgccgacgacgatgtcgagcttgccgtcctccagcgcgagctcgtagtcgaatgcggggccgagcgaatggaactcgagcgtcgcgttcggcgcggccaggcgaaagcgctcgacgacggtcggcacgaacagcacgttcaggtagtcggggcagccgatccggtagcagcggatcgacgtggccgggtcgaagttgtgctgctggaacttgatccgctcgatttcacgcagcgcgttctgcacgggctcgagcaggcgcagcccgtattcggtcggcaccatgccggatttgccgcgcaccagcagcggatcgccggtgatgtcgcgcaggcgccgcagcgcggcgctgatcgccggttgcgactggttcagtttgacggccgcgcgcgtgacgctgcgctccatcaacaaggtgtgcaagacgcgcaagaggtacgtgtcgatcgcctcgcgttgctgactcatgatttctccgggttatatggctgggctgatcgaggggtactgtgggtatatcgtttttaatatgaacgaaaatcagcgtcaagagatggatacccgcaggcacccgccggccgggccgcgacaaggggcctgaacggggctgcaagcgggcgcgccgcgccgtgcggaggcacgtgtggtgcgactccggatcgcggcgcggcgtggggtgcgacgggcgcgtcagtcgtcgatgcgcatgccgaccttcagcgtcacctgccagtgaaccacctggtcgccttcgatgtggccgcgcgtttcggtcacctggaaccagtgcaggttgtgcagtgtcttgccggctttcgagatcgcgttgcggatggcgtcgtcgctcgattgctgtgacgaaccggtcagttcgatcatcttgtacacgtggtcgctcatgatgcgctccctgggatatcggcatatatcgccggtgcaggtcgcgttcccgaagcggtgccgcgcgtgcccggcttcttgagtgataggtatgatgggcggcaagtgcaacccatatcggagacgaggaacatcgtggaagtcggattttgcggaccgggattgatgggcgcgccgatgattcggcatttgctggcggccgggcatcgggtcagcgtgtggaatcgttcgcgcgacaaggccgaggcgctcgtgaaggacggcgcgcaagtggccggcacgccgcgtgaactggcggagcgcgtcgatacggtattcatgtgcgtgctcgacggccgcgcggtgggcgacgtcgtgttcggcgagcacgggctgctggccggcgacgccgccgcgcgtcgcctgcaacgcatcgtcgatcattcgagcatcccgcccgccgcgacgcgcgattacgcggcgcgcgcggccgcactcggcgtcggctggatcgatgcgccggtatcgggcggcgtgcccggcgcgcaggccggcacgctcgcggtgatggccggcggccgcgcggccgatctcgacacggtgcggccgctgatcgacacgtacgcgtcgcgcatcacgcacatgggcgacgcgggcgcggggcagacggcgaagctgtgcaaccaggcgatcgtcaccgcgacggtgaccgcgattgccgaggccgtcggcctcgcgcaggcgagcggcatcgatgccgcccgcctggccgaagcgctggccggtggctgggccgattcggtgctgctgcagacgttcgtgccgcgcatgacgtcgggcggtcatgcaccgatcggcgcgctcggcacgttccagaaggacgtcgatgcgatcgccgacgcggcccgcgacacgggtgcggtgatgccggtgtcggccaccgtgcagcaggtgctgcggctgggcgccgcgcaagggctcgccggcgccgatttcgccgcgttcatcgacatcgtgcggcccggcaacgggcgtcggcaggcgtcgtgacgggcaagcggggcgggtgaatggcagatgggccgcccggaggcggcccatcgaatggcaggcggatcagccgagggagcggggtgtcgtgtcgccggcgttctggcggccgagcccgccgcgcaggctcgctttcgtgcctgcaccaaactcgggcaggatgcgcgcgcgcacggctggcgaacacgaggaaaccgaagccgttcgcttcgtaccagtaaccaccgttctcaaggccgtcgagcggctgctcgagcgcgttggcgatcgattcgatgcagcgcttgcgcaactcggcgatggcgggatagggcggctgggcgccgcgcacgctgcacaggagcacgtcgagaccgggcagcacgtgggcgtacaggacgggttcgtcctgcgcacgggcgcgggcaatcttggtgtcgagctgggcaaacggtttcgagtggcgcaataccgcgaggaatgactcctggccatcctgctgggcacgccgacgtttttcgggaaggacataaacactcgcctcaaaaacaattgcaagaaatgcggcattttcatgcgacccactcccggctatgtacgccgcatgtcgatcctttatagcacacgaaaatgctgccttcgtgcagtacgacgatcaatgtctcccgtcgacctgctcgccatgatcgacacagtcagcgtcttggcgcccgtactgtcgtttagtctccatcatagacctgcttttcccgcgcgtgcattcgcccgtcacaaaaagtgagataggccgcatgcggcggtgcatcgcgcgcgcaataaaaggcccgcacggggcgggcctggcaggtggggtgctcggcgatcagcgctgcttcagcgaatcgcggatctcgcgcagcagcacggtgtcttccggcgtcgcggccggtgcggcttcttccggcttgcgcagcttgttgatgaatttcaccatcaggaaaatgatgaatgcgaggatgacgaaattgatcgccacggtgatgaacgagccgtagccgaacgcggcgacacccgcggcctgcaggtccttgaacgaatcgggattacccttgaacgtcgggggatggtgccgagcagaacgaacttgttcgagaaatccagaccgcccgtcagcacgccgatcaccggcatgatgaggtctttcacgaccgagtcgacgatcttcgagaacgcgccgccgatgatcacgccgacggcgagatccatgacgttgcccttgacggcgaactccttgaattccttgatgatgctcatgagcggctttctcctgttggggcgagggaggcgtgccgcgacgcgcagggatgcagagcgtcgaatgagggtcggtggcacgccgatggccgcatgatagcgaacgctccccattgccggtagtccatcttgaaatgattgacaaatccgcgcgtcggcgcggccggcgctgaaggggagcgtggcgtgcgttgcagtgcgccgcgggtgtgtcgacgcgctgcgcggcgtcaggtgttgtcgtcggtccagccgtcgtcgttgctgccgaggtccatgccgccgccgccgttgccgtcgctccagttcgacgcatcgccgcggccgaggtcgaagcccggatcgttgtcctgccggtggcgttcgccgtcgacgatcacgtcgcgttcgaccacgcgttcgcggccgcccgacatcgcctcgccgagcaatacgcccgtcagcagcccgcccatgccgccgccgaaaccgccgccgccttgctggatcacgacaggcggttgctgttgcgggtagggttgcggcggatacggctggccctgcgcgcccgtcatgcgatcggcttcctgcgcatacacggagccgctgccgttcgccggtgcagcaggttgcgcggccgggtcgggacgcccttcgacgcgtgccttcacgctcgcatggcgctgttcgagttcatcgacgcgatagggcggtaccggattcttgccgttggacagcgtttcgacgagcgtgcgcgcgtcggtctcgatcgcttcgagctcgcccgtgagcgccgcggccccggcgccgtcgacagcttcgcgtcgagcttcagcgggcggatgtcgttcagcacgtcggtggcgcgcttgagctgcgtgcggcgctcgtcgtcggcgcggctgtcgtcagccgtgcgcgcgcgccgcagcgtccagcgcagcaccagcgcgatcaccgcgacgatcagcccgaggccgatccacatgccggtcgacgggccgtgtttttcggccggcgcggcagcgggcgcgagcgacgattgcagcgtgccggcctgcgtcgccgacggtgcgttgccgctcacgcgcgcggcgtcggcgcgaatgcgcgactccgtctgggcaaagcgcgacgcatcggtgaacttcagttgcggatcgagcgacttcgcgcgctgcagctgcgcgagcgcatcggacgcgcggccctcgcggtccagcacctgcgcatacaggtagcgcgcgtgcgcgttgttcggatgggcgtcgatgacttgcgacagctgcgtgtcggcttgctgccagttgcgttgcgcgatcgactgctcgacctgctgcagcgacgggaccgcaaacgcggcggatgacagcaacatcagcgagaggccgagtgcggcgagagatttcttcatggtcgaaccgggcgcaggcgcccgtctcctgacaatcggttcgcgccgcgcgcccggggcgggcggcggcgcggttgcccgcagttgccgttactgcgcgggcgtgtcgagctgcttcttcagcgcggcgaggcgatcctcgaccgacgggcccttgttcagcgcggcgagcttgtcgtcgagtgccttgccgctcgacgtgtcggcggaattgaggcgcgcgtccgagcgggcgttctgcagcgcgaccttgtcctcgagcttctggaagtcttcggacaggttcttgccgccgatgccgcccagcgcgcttgccgcgacatccttcgcctgcgcgatttcctgcttggcctgcaggatgttcgagcgcgcattcaggtcgttgcggcgctgacgcatgtcggcgatctgccccttcagcttgtcgaccgacggctcgagcgtcgacagctcggccgcgagcgcgtcacgctcggcttccgcgttcgactgcgcgccgagcgcctcgcgtgcgagtgcctcgtcgccggcctgcagcgcgcttcgcgccgtcctcgtacttcttcaccttgtcgtcggccgcatcgcgcttgctgcgctgggtcgcgacctgtgcctcgatctcgatcagcgaattctcggcacggccgatgctgtcgtcgagctcccgcacgatctgccgtgcgtcgcgcgacggatcctgtaccgaatcggccgcatcgttcagcaggcctttgatcgtgcgcgaaacagagtcgaaaagcgacatgaaatcctccgtggttgaaaggcgccgcgtagccgcggcagtgcccgtagcgagccggttccgacccgcatgagccggcggatattacaccaccggttcacttaaatacggcttaaacgcgcgagttcaagcggcgcgcgcatcaggatgtcgaacctttcgcggttgaaagaaaatcgaccgtgcgcaccatattgcgtgtccatgataggcagaggatgccgacaatacgttcctcaaatcacggcattgcgggaatttttacaaaaatcgcgaaggcccccggtcgatttcattaaaatgcgctgtcacgtcgcgggaacggatcgccgcgcggcgggtctgtcgacgtgacagccgcatcacgctgtacccgctctgattcatccgcttgcatttccgcatgcgtccgagggtgccacgtacgcccgccattccgacatgccaattatcaaacgaccgccttcttcttccgacaggaacgaaccccactacacgctgcgccgttcgccgtccggagcctattaccccgatgacgacgatcgcgacgacgaccgccgcacccagcgcagcagcggcggcggagggcgccgtcgctcgttcggctcgcgcgtcgcgctgtggttcgccggcctgttcgcgacgctggcgatcgtcggcgcgctgatcgtcggctacgcgctggtcgtgatggcgccgcaactgccgtcgctcgatgcgctgaccaactaccagccgaaggtgccgctgcgcgtgttcacggccgatcacgtgctgatcggcgagttcggcgaggagcgccgcagcctcgtgcggttccaggacattcccgacgtgatgaagaaggccgtgctcgcgatcgaggactaccgcttctacgagcacggcggtgtcgacttcgtcggcatcctgcgcgcgggcgtcgccgacctgatgcacggcggcgcgcgccagggcgcgagcacgatcacgatgcaggtcgcgcgcaacttcttcctgtcgagcgagaagacctacacgcgcaagatttacgaaatgctgctcgcgtacaagatcgagaaggccctgacgaaggaccagatcctcgagctgtacatgaaccagatctatctcggccagcgctcgtacggtttcgcggccgccgcgcgcgtgtatttcggcaaggacctgaaggacatcacgctcgctgaagcggcgatgctcgcggggctgccgaaggcgccgtccgcctataacccggtcgtcaatccgaagcgcgcgaaggtgcgccaggaatacatcctgaagcgcatgctcgaggtcggctacatcacgcagccgcagtacgacgaggccgtgaaggaagagatccacgtgcgcacgccgggcaaccagtacgcggtgcacggcgagtacgtcgccgagatggtgcggcagatgatgtaccagcagtacaaggacgaaacctatacgcgcgggctgaccgtcacgacgacgatcaattcggccgaccaggaagctgcttaccaggccgtgcgtcgcggcattctcgactacgagcgccgccacggctatcgcgggccggaagcgtcgatccagctgcccgcggccggcgacgaccgcgacgaggcgatcgacgacgcgctcgccgatcacccggacaacggcgaccttcagtcggcggtcgtgctgtcggcgtcgccgaacgcggtcgaggtgcagttcgtcggcggtgcgaccacgacgatcgggccggccgggctgcgctttgtgtcggccgcattgagcccgcgcgcgaacgatacgctgcgcatcaagccgggctcggtcgtgcgcgtgctgaaggacggcaagacgggctggcaggtcgtgcagctgccgcaggtcgaaggcgcgctcgtcgcgatcgcgccgcaggatggcgcgatccgctcgctcgtcggcggcttcgacttcaacaagagcaagttcaaccacgtgacgcaggcatggcggcagccgggctcgtcgttcaagccgttcatctactcggcgtcgctcgacaagggcatggggccggcgacgatgatcaacgacgcgccgctgtacttcccgccgagcgtgccgggcggcaccgcctgggagccgaaggacgacgaccagccggacggcccgatgacgatgcgtaccggcctgcagcgttcgaagaacctcgtgtcgatccggatcctcgcgtcgatcggcacgcagtatgcgcagcagtacgtgacgcagcgcttcggcttcgatcccgcgaagacgccgccttacctgccgatggcgctcggcgcgggcctcgtgacaccgctgcagctcgcgacgggttatgcggtgttcgcgaacggcggctacaaggtcgatccgtacctgatcgccgaggtcgacgacgcgcgcggccagccgctgcagaagtcgcagccggtgctcgcgggcagcacggcgccgcgcacgatcgaaggccgcaatgcatatgtgatgaacagcctgctgcattcggtcgcgacggcgggcacgggtgcgggcaccaacgcactgggccgcagcgacctgcagggcaagaccggtacgacgaacgacgcgaaggacggctggttcgccggctaccagcaatcgctcgtcgcggttgcctggatgggcttcgaccagccgaagagcctcggcagccgcgagttcggcgcgcagctcgcgttgccgatctgggtgaactacatgcgcaccgcgctgaacggcgtgcccgagcagcagatgccgatgccggacggcctgacctcgatcgacggcgagctgtactacgccgatcgcacgccgggcaacggcttcgtcgcgaacgtcgacatcaacccggccgagaacgcgatcagcgcgaacgacgcgctgggttcggccggtgcggccgggctggcgccgccgcccgtcacgccgcaggagaagcagcagatcatggacatgttcgagaacaagtaagcgggataccgctgttcatgcatgcgacgggcgccttcgggcgcccgtttttgtgcgtcgaggcaagcgggagcggctgagtcagaacgacgcgcaggcaggcaccaccgtcatgccgaccgattcctgatgaaaccgctccatataggccttgcgtatcgcggcgagccgcacgcgcgtgtcgggcgtatcgtcggcgatgatacggatcacgaagctgtcctcgcgcgtgatgccgcccgtcgtgcggtcgcgccattggccgtgtgtatcccagtaggtcaggccgtcgggaaaacgcggcgtgaccgtgtcggcgagaaacgccgcgcgctccgcatcggtgacggagccgtgtcccgcgatgtcgcgcccgaacagcaggtcggcctgcagcatgcggctctcgcccgtctgggtgcaggccggcgccgtgccggcggcgggcgggggcgcgggcggtgccgcgcaaccggcgagcagtgcgatcgcgacgccgccgatcatgggcgccgcgcggtgccaccaggccgcggggcgggcggctgaaggccgcatctgcccaattcgtgtcgatcgacctccgcgcgcgcaaaacgctgcgcgctcaaccacttgcgtgcttgtccggcgggttatcaacagggctgtcaacataatctggggataaccctaggttggttcgctgacgcccggcgtgcgatcagtgctggagtttcgcgtgcgcgagatgcatgccgagcgtacccgggtcggtattcgtgcccgacagcagcacgccgacgcgcttgccctgcagcgtttcgcgcagcgggccgagcagcgcggcgagggcggccgcgcatgccggttcgaccgacagcttcagttgcgagaacaggaacagcatcgcggcacgcagcgcgtcgtcggacacggtgacgatgcggtcgacgtggcgccggcacagctggtagctgtattcctcggtatgcggcgccatcagcgaatcggcgatcgtctgcatcgcgctcatcttgatcgtgtgattggccgcgaagctgcggctcatcgcgtcggcgccttccggctcgacgccgtacacgtgcacgcgcggattcgcgagccgcagcgcggtcgccatgccggccgcgagcccgccgccgccgatcggcacgatcaccgcgtcgaggtcgggggtctgagtcgcccattcgtagccgagcgtcgcggtgccgaggatcgtgtgatagccgttgaacggatggatgaagaagcggccttcctcggcctcgatccggcgcaccagatcgaacgcctgcgacgcgctgcctgccagcacgacttccgcgcggtactgcttgcactgcgcgatgcgcgtcgggctcgcggtgtggaacatcacgaccttggcgctgctgccgagccgcatggccgcatacgcgacggccgccgcgtgattgccggccgacacgcaggtgacgccggcgttcttgcgcgcctcgtcgagcgcgagcaggtgcgtgaacgcgccgcgcgccttgaagctgccgctcacctgcagcagctcgaacttgaagttgacgtgcgtgccctcgagggacggcaggtcggcgcgttcgaacacgggcgtgcgcgcgacccagggcgacagcgcgaaatgctgcgcggcgatttcgtcgagcgtcgggatcggctcgccgtcgatcgtcgtatgggccgtgccctgttgttcagtcgacatgacgtggcgggtggcggagtgggccggcccgcacacgcgggccggcgtggcgggaggcagtcagtgcgcgtcgaccgacatgctgcggatgaacttgcgcaggaactgctcgcagccggcgagctgcgcgagctcgacatattcgttcggcttgtgcgcctgctcgatgttgccgggcccgcatacgacgctcgggatgcccgcgcgttcgaacaggccggcctcggtgccgtatgcgaccttgcgcttgtcctggtccgccgtcagcgcgcgcacgagttgcgtgatcgcggcctgttcggttgcgtcgaggccgggcgccgcggcgatcttcgaaaattcgatcgcggcattcggatgctcgcggagcatctgcggcagcagcgtttcccgtgcatacgcttcgatgcgcgtgaagatctgctcgggatcgagcgtcggcaggttgcggaattcgaagtcgaagcggcactcggccggcaccgtgttgatcgcgttgccgccctggatcgtgctcgtctgcgcggtcgtgaacggcacgtcgtacagcgcgtcgaacgggccttcggcgcggaagcggtcggcgatgtcgcggatgtggcagatgaggcgcgccgcatactcgatcgcgttcagccccttcggcgtcagcgacgaatgcgccgcatggccgcgcacgcagcagcggtatgcgttgatgcccttgtgcgcgatgatcggccgcatgctggtcggctcgccgacgatgcagcccgacggttgcacgccgcgcttgacgaggtcggcgatcatcagcggcgcgccggcgcagccgatttcctcgtcgtaggacagcgcgaaatggatcggcttcgcgagcttcgtcgcctgcatctcgggcagcagcgcgagcgcggcgccgatgaaacccttcatgtcgcaggtgccgcggccgtacaggcggccgtcgcggatttccggcgcgaacgggttgctgtcccattgctggccgtcgaccggcacgacgtcggtatgccccgacagcacgatgccgccgttcgtcgagccgtcgtgcgcgggcacggtcgcgaacaggttcgcccagccttcgcgtggatcgtgcgtgatcgtcgaggcgatgcctttcgcggcgagcgcgtcgcgcaccgtttcgatcaggccgaggttcggcacgcggctcgtcgtgtccatcgacaccagttgcttgatccagggcaggctgacgagcgacgcgtcgccttgggtgtcggtggacggcgtcgtggcgtcgagagtggacatggcaaaactccgtctgatgaatgcgaaaatcatactcaaaaacgcgccggcccgcccgcgccgcgcgcagtgcggtgcagcatcggcgcgtccgtcaggaccgcgtcacgacccgtcagcgcgccgcggccaccgcgccctgcctcggggcgagcgcgcgcagcgtttccttgatcgtcgacacgcggatcgcgaggtcgggcgagcgtgtctcgatccgcagcttgtcctggcccgcgagcttgatgtgccggtgcttctgcaccatctcgatgatccgcatcggatcgatcggcggattcggctcgaactgcagcccgatcgcggcctcgctcgcgtcgatcttcacgatgccgagcggcttcgcggcgatccgcagccggtgcgtctcgacgagcgcgtgcgcctgcggcggcagcttgccgaagcggtcgatcagttcttcctggataccgtcgatcgcgtcgccgtgctcgcagttcgcgagccgcttgtacagcgacagccgctcctgcacgtccgcgcagtagtcggccggcaggatcgccggcgcatgcaggttgatttccgtcgtcgcggcgagcggggcggtgaggtcgggctccttgccgttcttcagcgccttcaccgcgtcgttcagcatgtccgtatagagctggaagccgatctcgtggatctcgcccgactgcttgtcgccgaggacctcgccggtgccgcggatctcgaggtcgtgcatcgcgagatagaagcccgaaccgagttcctccatctgctggatcgcttccagccggcgctgggcctgcttggtcagcgcctgcggatcgtgcacgagcaggtacgcgtacgcctggtggtgcgaacggccgacgcggccgcgcaactggtggagctgcgcgagaccgaacttgtccgcgcgatgcatgatgatcgtgttcgcgctcggcacgtcgatgccggtctcgatgatggtcgtgcacagcagcacgttcgcgcgctgcgccacgaaatcgcgcatcacccgttcgagctcgcgttcgtgcatctggccgtgcgcgatcacgatgcgtgcctcgggcacgagcgcctccagcatcgccttgcggttctcgatcgtctcgacctcgttgtgcaggaagtacacttggccgccgcgcttcagctcgcgcagcatcgcctcgcgaatcacgctttcttcctcgcggcgcacgaaggtcttgatcgcgaggcgcttctgcggcgcggtcgcgatgaccgagaagtcgcgcagcccctcgagcgccatcccgagcgtgcgcgggatcggcgtcgcggtgagcgtcagcacgtcgacctccgcgcgcagcgctttcagcgcttccttctggcgcacgccgaagcggtgttcctcgtcgatgatcacgaggccgaggcgcttgaactgcacgtccgacgacagcagcttgtgcgtgccgatcacgatgtcgacgctgccttcgttgatctgcgcgatcgccgcgttcacttccttcgtcgtcttgaagcgcgacagctcgacgatccgcaccggccagtccgcgaagcggtcggcgaaggtctgcgtgtgctgctcggcgagcagcgtggtcggcgacagcagcgcgacctgcttgccgcccagcaccgcgatgaacgcggcgcgcagcgcgacctcggtcttgccgaagccgacgtcgccgcacacgaggcggtccatcggcttgccgctcgtcatgtcgccgatcacggccgcgatggctgccgcctggtcgggcgtttcctcgaagccgaagctctcggcgaacttcacgtagtcgcgcggatcgagcgagaacgcgtggccttcgcggccgcgcggcgcgcatacaggttcagcagctcggcggccgtatcgcggatctgctgcgcggccttgcgtttcgcgcgctcccactggccggagccgagcgcgtgcagcggcgcgctgtcgggatcggcgccgctgtagcgcgagatcacgtgcaattgcgcgaccggcacgtagagcttgctgtcgcccgagtattcgagatgcaggaattcggtctcgccttcgccgaggtccatcgacacgaggcccatgtagcggccgatgccgtgctgcgcgtggacgaccgggtcgccgaccttcagttccgacaggtcgcgcaccatcgcgtcgacgttgctggcctgttcctgccggcggcggccgcgcggcggccgagcgcgccgtacagctcggtctcggtgaccaccgcgtagccttcgcccggcactgcaaagccgttcgcgagcggcgcgacgccgagcgcgaagcgttcgtcgctctcgagccagcccgcgaagtggtcgttcgacgcggggcgcagatggtgttcggcgagcagttgcaggatcgtctctcgacggccggccgattcgacggtcagcaggacgcgcttgccggacgattcgacgaacgtgcgcagcgacgcgagcggatcgtcggcatggcgatcgacggagagctggggcagcgccgtcgcccagccgccggccggctgcgcgggcagcacgatgcgtgcgaacggcttcgcgaacgcgaagaaatcctcgtcggacaggaagaggcgctgcggctcgaggatcggccgctcgcgatcgtgcgcgaggaacgcgtgacgctgcttcgtgtcggccgtgaagcggcggatcgacgcctcgagatcgccggcgaacacgaggtgcgcatcctgcggcaggtagtggaacagcgtggcggtttcgtcgaagaacagcggcaggtaatactcgatgccggccgacggcacgccgttaccgatgtccttgtagatcggcgcgcggctcggatcgccttcgaacgtctcgcgccagcggctgcggaaggccgtgcgcgcggcttcgtcgaacggaaactcgcggcccggcagcaggcgcacgtcgcgcaccgggtagaggctgcgctgcgtgtcggggtcgaacgcgcggatcgagtcgacctgatcgtcgaacaggtcgatccggtacggcagcggcgagcccatcgggtacaggtcgatcagcgagccgcgtacgcagtattcgccgggccgcacgacctggctcacgtgctcgtagccggccagcgtgagctgcgccttcagcttcgcctcgtcgagccgctcgccctgcgcgaatgcgaacgtgtacgcggccatgaacgacgcgggcggcatccggtacagcgcggtggtcgcgggcacgagcaggatgtcgcagcggccctcgccgagatcgtgcagcgtcgcgagacgctccgatacgaggtcctggtgcggcgagaacgtgtcgtacggcagcgtttcccagtccggcagcaggcgcacgcgggcgtcgggcgagaagtagcggatttcctgcgagagccgctgcgcgtcgaccgcgttcgcgcagatcaccgcgaggagcggcacgtcctggcggttgtcggcgagataacgggcgatggcgagcgcgtcggcggaaccatgcgcgccgtcgaaggcgaaacgctggccggacttgacgcgggcaatgggcgaggcggacggggtggaagcgttatctggcatagggacgacaggggtggcgtgcacgggcgcatcgcggtgcgccggtcgagacgaaagacctattataaaatccgcttctcgatttcatctttccggcgtttcccttcgtgactccccgacttttcgccctgattccctgtgccggcacgggcagccgttccggttcggccgtgccgaagcaataccgcacgctggccggccgcgcgctgctgcactacacgctcgccgcgttcgacgcgtgcagcgaattcgcgcagacgctcgtcgtcctcgcgcccgacgattcccatttcgacgcgcgccgcttcgcgggcctgcgcttcgcggtgcgccgctgcggcggcggctcgcgccaggcgtcggtgctgaacgggctgctcgggctggccgaattcggcgcgaccgaccaggactgggtgctggtgcacgacgccgcgcgcccgggcatcacgccggagctgatccgcacgctcgtcgcggcgctgaaggacgatccggtcggcggcatcgtcgcgctgccggttgccgatacgctcaagcgcgtgccggccggcggcgacgcgatcgcgcgcaccgagtcgcgtgacgcgctgtggcaggcgcagacgccgcagatgttccgcatcggcatgctgcgcgaggcgatcctgcgcgcgcagcgcgaaggacacgacctgaccgacgaagcgagcgcgatcgaatgggccggccatacgccgcgcgtcgtgcagggcagcctgcgcaatttcaaggtcacgtacccggaggatttcgcgctcgcggaagcgatcctcgcgcgccccgcgaacgcctcctgactttcacccctctcaatcggaacacgcatggatttcagaatcggacaaggctacgacgtgcaccagctcgtcgagggcgccctcatcatcggcggcgtgacgattccgtacgaacgcggcctgctcggccactcggacgcggacgtgttgctgcacgcgatcaccgacgcgctgttcggcgcggcggcgctcggcgacatcggccgccacttctccgacacggacgcggcattcaagggcgccgacagccgcgtgctgctgcgcgagtgcgcggcccgcatcaaggcggccggcttcacgatccagaacgtcgacagcaccgtgatcgcgcaggcgccgaagctggcgccgcatatcgacgggatgcgcgcgaacatcgcgaccgatctcgggctgccgctcgatcgcgtgaacgtgaaggcgaagacgaacgaaaagctcggttatctcggccgcggcgaagggatcgaggcgcaggccgccgcgctgctggtgaagcagggcggctgacggggccagcggcatcgcgcggttcgccccgcgcgatgcctcggcaatgaaaaatgccacgcatctgcgtggcattttcgtttgaagccggcgccgcgcccggcattgctgccggcgcggaacgcaaccgcttattcgccttcggcagcgatcacctgcgcggcggcgttgatcaccgatgcgatacggccgacgtcgcgcagctgcgtgacggtcatcccttgctcgttcttcagcagcgcatagtgcgacttcacgcagaagtggcacttgccgacgatcgacgcggcgagcgcgtacatctcgaacttgcgcttgtcgacgccgccgtgcgtcgcgtacgcgcccatccgcagttcggcacgttgcgtcttcaggtcggcgtcgtcggccatctcgacatacggataccaggtgttgttcatccccatcagcgcggccgccgtcagcacggcattcgtctcttcgggcgacaggacgccggcttcgcggatcgtcttgatgagtaccgtgctcttcgccgcgatcgccgccgccagcgcgacgccgaccgcgtcggtgccttcgagcgacgagcgcgagatcgtgccgtcgaggttcaggcgaatgtccttcgcgtagtcgggaatacgtgccttaatcgaatcgatgaattccattgatatctcctatgggttggccgttaaaaagcccgcaggcaggacgtgcgccgcgggcttcgtgcatcgatgcgcttacagcgttgcgccgccgactgcacggttgcacgggcagagttcgtccgtttgcaggccgtccagaatccgcaggacttcttccgggctgcggccgacgttcaggttgttcaccgaaacgtgctggatcgtgttgtccggatcgacgatgaacgttgcacgcagggccacgccggcttccttgtcgcgcacgccgagctggtcgatcagctcgcccttgacgtcgccgaacgagtagtggttcagcttgtcgaggtccttgtgctcacggcgccatgcgagcttgacgaattcgttgtccgagctgccgcccagcaggacggcatcgcgctcttcgaactgcttcgtgagctttgcgaattcgacgatttccgtcgggcacacgaacgtgaagtccttcgggtagaagtagatgatcttccacttgcccgggaacgacgcttcggtgacggtctcgaatgccgactggccgttttcttcgtggttgttgaagcccggcttcgcggccacgacggtgaaagcttcgagtttatcgccaacggttttcatgcggatactcctgtatgagttgggaagaagactgagtcaagctacctcggtgctgcaacgatggtgtgacagcatgggtgagactgtaacactattagtaaggcgcttcaatagattttgactaactccatccatagtttttcaaccggatcgatagtgtgaagggcggcaggcgtacgcgagcgcgtcacgccgtcgcacgtgccttgccggcgccggggaattcgagcgtgacttcgaggcccgcgtcggggctgcggttgcgcaggcgcagcgcaccgcgatagcggccgacgaggcgcagcacgatcgccatcccgagccccgtgccgtccgccttggtgcgcgccgtgtcgacgcgatagaacggccgcatcacgagcggcagctggtcctcggggatgccggggccctcgtcgcttaccgacagctcgacgcgcgcgtgcgtcacgcgcgtctcgagcgtgatgcgcgacacgccgtcgtcgcggctctggccgtatttgcgcgcgttttcgacgaggttgccgatcacgcggcgcatgtcggtctcgtcggcttcgatcacggcgttcggcgcgagccgcgtgcggatctcgacgccgtcctcgcccgacacgcgcgcggcgacttcgtgcgcgatcgaggagaggtcgaccggctccggcttgcgctgggtcggacgcgcgtagtcgatgaaggccgcgatgatgcgatccatttgctcgatgtcgtcgaccatcgcgtccttggtcgcctggtcggacgggctcatctcggtctcgagccgcagccgcgcgagcggcgtgcgcaggtcgtgcgagatgcccgcgagcatcagcgcgcgatcggcctcgagctgctcgaggtcgcgcaccatctggttgaagctgcggttggtgtcggccgcgacgcccatcccgcgctcgggcagcgggtcgggcgcctgccccgagccgacctggcgtgcgacgagcgcgagccgcgagaacggccggttcacgaggctggtgatgaacgcggagccgaacagcgacagcgcgagcgcgaacaaccccagccggcccactgcaggcccgtgacgttgtcgagctggtcgcggtcgagcgcgacccagtaatcgtcgtcgtcgatcttgaagctgatccacacgccgggaatgtcgttgaccgactgtgcgatcacggtatcgtcgccgaggcggctgcggatgtcgtgctcgatcaggcggttcagcgattcgtcgggctgcagcttgaacttgtcggtcttttcgcgcgggtacacgcgcacgccctcgttgctctcgagatcctgcagcagcgcgcgccgcaggtcgggatcggaatagagcagggcggtgcgcgtgagcttcacgaccgcgacgagctggagagccacgcgctgcgcgcgcggctcgcgctcgatcacacgaaagctctggaaccacgcggcgagactgaccgagatcagcagcgcgatcagcaggaaggtgcgccagaacagcccgccgaacgcgagctgcaggaggcgccggtcgatacgcatgggacgggccgtgggcgggcgaaaccggaaaggaaaaagatcaggcggcgccgtccgggatgaacacgtagccgaggccccagacggtctggatgaaacgcgggctgcccggatccggttcgatcagcttgcgcaggcgcgaaatctgcacgtcgaggctgcggtcgaacacttcgtattcacggccgcgcgcgagttccatcagcttctcgcgcgacagcggctggcgcggatggcgcgcgaataccttcagcaccgagaattcgccggtcgtcagtggaatttcctggccggatttcgtcagtgtgcgggtcgcgaggttcagcgagaactcgccgaactcgaacacctcggtggtttccgacggtgcgcccggcagctcggccggcgcctggcggcgcagcaccgcatgaatgcgcgcgacgagctcgcgcgggttgaacggcttcggcaggtaatcgtcggcgcccatctcgaggccgacgatgcgatcgacgtcctcgcccttcgcggtgagcatgatgatcggcgtgcggtcgttgctgccgcgcaggcggcgacagatcgacaggccgtcttcgcccgggagcatcaggtcgagcacgagcaggtcgaaacgctcgcggacccagagcttgttcattgcggttgcgttttcggcgacgtagacattgaaaccctgctcgccgagatagcggcgcagcagatcgcgcaggcgcgggtcgtcgtcgacgacgagaatcttggagggtttttcgtttccatgatcggcatcttatcgcgaatgggaattgacgcacggccgcgtattttcgtgcgttacagtcggttacaaaatttacccgtagtgtcgcgccgagtaaaggcaggctatatagattcctttactcgaagccgaaattcggtagatactcccctgcactccatcattcatctttgcacacccgaattccgcagggtttttcaagtaccagaggtaaccggttgccgcgtgacgaagggaacaaatcgaccaaagaagcgaggacggtcatgcgatctgcccggattgcactgatgctgacgatcgcgctcgccggtccgtatgcgtcgaacttcgcgtatgcgcagcgccccgagcagggcgcatcgtcgcgcaagctgccgcgcggcaaagcgccgcagtccgatcgtaccgccgagatgacggtccgttccgccgtgcctcccgatctcgaacagcgccgccgcgacgggcacatgacgcccgaggagcgccacctttgcgccagcacatcgaggacgccgttcgcgagctgtacaagcgctgacgcgccgtctttcgtcctgcggattacaacgcgatacatcgcgcggaaaagattcgtagcaatttttccgtcaactttcgcctgccgattgccgttgtaccggcatccgcaccgccggtgcgcaccgggagtccatgacgatgaaagcgaacgctgccgcaccggcgccgtcgcccgccatgcagtcgccgctcgacgccgacgatgcattgtttttcctgagccgtaccggttttctcccgcgcccgccgatgttgcgcgcatcgtcggcatgacgcgcgcgcaggtcgtggccgacacgctcggcagtgttcggcgcgagcccgtcacgacgtggccggactggatcgccgagttgccaccgacgcgcgcgcaacgccaggcgctgaccccgacatgcggcgcgacgagcagcgcgagcgcaatgtccgctacgatgcgctgcgcgcggcctgggtcaacgagatgatcgtcacgccgtcgccgctgaccgagcgcatgacgctgttctggcacgggcacttcacgtcggggcaggacaaggtgccttatccgcagacgatggccgcgcagaacgcgctgtttcgccgcgaggcgctcggcaacttcggcgtgctgctgcacgcggtcgcgaaggatccggcgatgcttcagtatctcgacggcgcgagcaatcgcaagggccgcccgaacgagaacttcgcacgcgaggtgatggagctgttcacgctcggcgaagggcattacacgcaatacgacgtgaccgaagccgcgcgcgcgatgacgggctggacggtcgatcccgacacgcttcgcttcgaggtgcggccggaatggcacgatgcgggcgacaagacgatcctcggcgaaacggggccgttcgacggcgacggctttctcgacatcctgctgaagcagcccggcaccgcgcgcttcatcgccggcaagctgtggcgcgagttcgtgtcggatacgcccgatccgggcgcgctcgatgcggtggccgagcggtttcgctcgagcggctacgacattcgcgcggcgctcgccgcgctgtggtcgaccgacgccttctgggatccgcgcaatcgcggcgtgctcgtcaagtcgccggcggaattcgtcgtcggctcggtgcggctgttcgacgttgcgtacggcgatccgcagatgcttgcgaacaccgtgcgcacgctcgggcagaacctgttctatccgccgaacgtgaagggctggccgggcggcgcgctgtggatcaacagcaccacgctgcttgcgcgcaagcagttcgtcgagcaactgttccgcgcgaccgagacggccggcatgcacccgccggcgcgtgcgatggcgccgccgccgaatgtccgcgcgcacgcgatgccggtgatcgatgcggcgtccgccgccggcatgcgcgcggcgcctgccaggcccgcgcgcggcggcctgcgtttcgacctcgaacgctggctcgcgcaatatcgtgcgcggccgcaggcgatcgcgggcttgtcgaccgagcttcagttgcagcacgcggtgctgcagctttcgccggtcgcggcgatcgacacggattcgaccggcagcgcgtatctcgaggcgctgctgatggatccggcctatcaactgaaatgattcgaacgacgatgaagcggggagccggcgcggcaaaggtgccgggcggtgaaccaaaggatgcgcgatgaaccgacgtgattttctgacgctgacgggcgccgcggccgcagccggcgtgtcgctgtggcaggcgcccgcgatggctgccaccggacggcagccggcggcagggtatgcgaacgtgctgatcctcgtcgagctgaagggcggcaacgatggcctcaacacggtggtgccgtatgccgatccgctgtattaccagttccggcgcagcatcggcatcaagcgcgagcaggtgctgcaactcgacgcgcacacggggctgcatccgtcgctcgcgccgctgatgccgctgtggcgtgacgggcaggtcgcggtcgtgcagggcgtcggttatccgcagccgaacctgtcgcatttccgctcgatcgagatctgggataccgcgtcacgctccgaccagtacctgcacgaaggctggctcacgcggacgttcgcgcaggcgccggtgccgcccgggttcgcggcggacggcgtcgtgctcggcagcgccgagatggggccgctcgcgaacggcgcgcgcgcgatcgcgctcgtcaatcccgcgcagttcatccgtgcggcccgcctcgccgagccgtcgtcgttgcgcgaacagaaccccgcgctcgcacacatcatcgacgttgagaacgacatcgtgaaggccgccgaccggctgcgcccgcgcggcgggatgcgcgaattccggacggcttttccggccggcgcgttcggcacatcggtgaagaccgcgatgcaggtgctggccgcgtgcgaagcgtccgggcccggcgcgcaggatggtgtcgcggtgctgcgcctgacgctcaacggcttcgacacgcaccagaaccagccggggcagcaggccgcgctgctcaagcagttcgcggaagggatgagcgcgatgcgcggcgcattgatcgaactcgggcgctggaaccagacgctcgtgatgacgtatgcggaattcgggcggcgcgtgcgggagaaccagagcaacggcaccgatcacggcacggccgcgccgcatttcgtgatgggcggtcgcgtggccggcgggctgtacggcgcaccgccggcgctcgggcggctcgacggcaacggcaacctgccggtcgcggtcgatttccgccagctttatgcgaccgtgctcgggccgtggtggggctcgatgcgacgcgcgtgctgcagcagcgcttcgacacgctgccgttgttgaaggcgtgatgcgtcgtgacgttcagcggcggcgcgcggcgcgccacgcgatccacagcttgcggatcggcgtcagtgcaatgcgctggtgcagcacctggtagtcgtcgcgctcgatttcgtcgagcagcgcgccggccagtgcgatctgcgcgcgcagcgtgcgctgtgcgcggcgcccggatgcggggatcgccgcttcggcggccgcaagcgcttcgcgtgcccgtgccgtctggaattgcagcagctcggtgaacgcggggctgtagcgacggttcagcaggtcggccgccgtcacgttgtagcgctgcagttcgtcgatcggcaggtagatgcggccgtggcgcgcgtcgttgccgagttcctgcacgaactgcgcgagcatcagcgcgcggccggcgtccgcggcccacggctgcgggtcggcggggttcgccgaactggcgcgcgcgaccagcgacgcgaaggtgccgccgacctgcgcgatgtagcgctgcagattcgcgaaatcgaggtagcgcgcctgttcgagatccatcccgtagccgttgacgagcgtgcgcaacgcgtcggcttcggcggtgatcgccgggtgatgctgcgcgagcgccttcgtgaccggatgcgacggctgtccgtcggccagcgccgcgagttccttgtgccaccacgcgagcttcgtgtgtccgacggtcgggtcgctggtttccttgacggtttcctcgagttcgcggcgcagcgcgaacagcgcggtcaggcgcggttgcgtggcgagcggcgcctgacgcaacgcgtagtagacgctggagcccgcaggggcggcctttgctgacagtagtcgtcgaagttcacgggcggaatcgtgtgggggcgggttcggggacgcgcggcggcgcggtgccgaaacgtcgagcgcggcattctagcaccgccgcacgacgggtgccggcggggcgagacaacgccgcccggatcgggtagaatctcgcgctcgcctgatcgggcgtgccggctcgaggccggcgcgatgttccggcgcgcggcaacgcatcttgcgtgccgcgtagtcaggcgacggaaaatgcgcgtgagtggcgaaattggtagacgcaccaggtttaggtcctgacgcccgcaagggtgtgccggttcgagtccggcctcacgcaccagaagtcgaacatgcactcgtcggggtgctgttcccgaaaagcgctgccggtcggctgaccgcagcgctttttgttgatgcctgtcttgttcgcggacgtgcagccgtacgaggagcgcaccctcaaattcggccgcatgtaatatcgtcagcgcgatcgaatacgagaagtacgagaacaccgaggggccaccgatgaaaaacaccgtacgcatcccgatttccgttctggcgctgatgctggccgcgccggcgtttgccaatacacctgccgacaacgtcgcatggagcgccaggccgctgcacgcggctgcatcgacgtcggcgtgctctgcgtactcggggcgggtgatggcgggcggcgagtcgctgtcgaccgaaaacgtgctgaaagcgctcggtacgtcgctggccggcgccgtgctgggcgccgtcaccggcgggtatcagggcgcggtctccaatccgtgcccgcgtcccggcctgtgaccggcgcgcaggcgagtcgagggctcgccgcgttatccggaacaagcccgacgaagcgccgcgcgtcacccgactcgcggcgcttcgccgtttcaggcgcgtctattcccagaaactccggatcgcaaccgccacgatcaccggcaccgaaaaaccagcgggatcgcgaaatactgcgcctcgcgatcgacgatccagctatagatcacccacgccgcgccgagcgcgaacgtgatgaggccgaccgtcacggcggcgatgttcagggccagtttcgaaggctggcggcgcgtcttggcatcgtcattgttgtcgcgcggggacgatttcatcggaagagtacggcttcgggccggaacgggaataaaggcacaggagaccccatccgctccgatcgcgcaagaggccgccgccggcccccggcgcattcgtcagcgcgcattacaacccgaacgacgccgccagttcgtcgagcagtccgcgctggaacgcgatgaaccgctcgcccggctgctgcgcgatcgcgaggtcgagcatcggatcggcgacgtcggtacgaatgccggccagttcctcgacgatcgcgagtccgcagaacggcacgtatgcctccgaatagccgccttcgtgaacgatcacgagccgcccgtcgcaatggcgctgcgcggcatccttcaccgcacgcgtcatgaaccggtagctgtcggtatgcaactgcatgcgcgcgagcggatcgaccgcactcgcgtcgaggccgctggcgatgacgatcagctcgggtcggaaacgcgccagcgccggcagtacgatccgctcgaacgcgtaccgataggcatcgtcgccgctgcccgcgagcagcggcacgttcaggttcgcgccgacgcccgcgccttcgccgcgatcgtccgcgccgctatagccgggcgggaagccgcggtcctgatgcagcgagatcgtcagcgtgtccggatcgtcgtagtagatcgactgcgtgccgttgccgtgatgcacgtcccagtcgatcaccgcgacgcgctcgatgccgtgtttcgcgcgggcggcctcgatcgcgatcgggatgttcgccagcatgcagaagcccatcgggcgatcgcgcaggcagtggtgaccgggcggccgcgacagcgaaacgcgttggccgcgcgctcgccgacgaccgtatcgacggccgcgatcgcaaggccggcagacagcgcggcgatctcgtagctccctttgccgaacggcgcgagatcgccgaggtcgccgccgttcgcgtcgctgagtgcgcggaacgcgtcgagatagtgcgcgggatgaatgcgcagcaggtcggcggtcgttgccggttcggcgccgcgcaggtcgagctgcgcggccaggcccgaggcctgcacgagcgacaggaaacggcgcttcgaatcgggcgattccgcgtagcccgcgctcgacggcggctggacccagccgccgaccgggaagaacagcgcatgcgtgccgccggtgtgccagaaagtgcgttcgtcggtaaaaaggcagtgcgattcatggatgtgcgagacctgtcacggttgggaggaaacggaggcgtgcgtgcggcgatcgatgtggcgcagcgcggcgaaagacacgatcgcgacggccgtcgcggccgtgaacagcgcgtgcatcgtgccgccggcgtcgagcatcagcccggcgagcaacgggccggcagcgaggccggcgccgatcacgaaattgagcgtggccacgaggcggcccgacgagtcgatctgcgcgacggtcgcgaggatgaacggcaggacgaacgtccacgcgaacttgaacgcgaagatcgccgcgctgtaaccgccggcttgccgcatcacggcgagcgcgacgagcgaggctgccagcagcgcgtaaccggccgtcagcatggcgcgccgcgcgagccggccgcccgcgcacgacgcgagcgccgcgccggcgatgcccatcacgctcgcgaacgcgagtacgttgccggtcgactgcggatcgagcccggcttcggccgcggcgcggctcgcgaacgtccacacgctgccgatcgcgagatagaacgtcagcaccgcgccgatcgcgagcacgatcaagccttgcggcgtctgtgccgccgcgccgcgcgcgcgttgcgcaggcgcggttcgtgcgcccagcgatgacgggaagccgcgcgacagcggcgcggcgagcagcgcgagcccggcgagcgcgacgtacagcgcgcgcagcccgaatgccgcgaacacgtgcggcagcacgaacaggccgatcgcgcccgcgatcaactggccgacgacccacaggccgtacacgcggtcgctgttctcgctcgttgcggcgctcgtcatgcagagcaccatcagcgaaccgccgccgagcgcggtcacggcgcgcagtgcgagcagcgcgacgaagcccggcatccacagcgcggtcagcaggttgcccgcgccgaacagcgcgatggcgaacgcggccacgcggcgtgcgtcgatgcgaccgagccacaggtacgacggtacggtcgcgaggctgaacgcgccgagttcgacgaagaagtaggtgccgatctgcgaggcggacagcccgagctgcgtcgtgagctggccggcgacggcgggcgccacgagcagcagcagcggcgtgatggccgcgaacacgacgagcgcgacgagcgtcgagcgcgcgaaggccgatgcgcggccgtcgggcgggagtgcggcatccggggacagggttttcatggcgggatctcgtgtggggaatcagaacaggtggtacatgccgaccatcgcgccgaactgcgatgcgccggcgagcggcgtcgggtcgtattcgtagacggtctgcgaactctggccgctgttgcgcgcatagccgaggttcacgtaggcgacggtgcgtttcgacagcgcatacgtggtgctcgcgatgaacagcgtcgggtggccgatggccggcgcgcgcgagtcggtgtggtagacgcccgcgttcaggccgatcccgttcggtgtcaggtagcgcgcaccgccccagacgatcgtgcgcgcggcgtcgaggtcgccggtcaggcgttcgacacctgcatagacggtgagcggcagcgcggcgaacgcgtagcgtgcggcgagcgtgccgagttcgcggcggcgcgccgacgtgtcgtcggccgccgatacctcgccgtgtgcctgatgcagcaccgcgctgaccgacaggccgttgctcgtgtactggccgccgagttcgagcacgcgtccggcgcgcgtattgccggcgacgccggacgtcgcggcaagcgcctcgacgtcgaagccggcgaacgtcggcgactggtacttgacggagtggtcgatgaagttcgcgttcatcggcacgatgacgccctggccgctgtacgacgcgtaccagagcgggtcgtagaacagcgtcttgtcgaacagcacgctgaactgacggccgagcgtgacggtgcccgcgggcccggcgatgccgacgtacgcgccgcggaagaacgcgtagccgggcgcggtcgcggtgccgtcgttgaggttgaggccctgttcgagcttgaacagcgcacgccagccgccgccgagatcctcgttgcccttcagcccgacctgagaaggcaggatgccgtagttctgcaactgcacggccgaacggcgcccgtcggcatgcgtcaggtattgcacgccggcatcgagcgcgccgtacagcgtgagggtcgactgcgcatgcgcgccggcgccgcacgcggcaagcgtcgcgacggccgcggccgtgcggatgaagcggggtttcgtcacgtggggttctccataccgtcctgcatcggtttgtcgttggtgttgtcgcgacgcagtgtccgcagcgggaaaaccttcgaacagtcgtacagatgaacggtgcggaaaacccgaggtgcgcggcatggtcgcgacgcgctggcgtcgcgcggcgtgctgcggagcagcaacgtgccgcgcaccgttcaaatggatggggctggcgccggttccggcaccggggcctgtcaaaaagccggtcgctataatcggccggtgtcgttgcgcacgtcagcagcccgatcgggcaggggagcggaaggtgaggatcacgacggatatcgggcaggatctcgaagcgctgcgtgacgtgccggcagccatcgtgctcgacgacttcgcctggccgccgctgccgtcccggcgtgcggatttcgacggcgtcacgcgcggcgacgcatcgcagcgcgagctcgggttgatgctgctcgacctgtacgcggttgccgcgcggtccggcatcggcgaattcgaataccgcttcttttcgctgctgcaggcgctcattccgttcgacgccgcgtggacaggcgtcgcgacgcatgtgccgaccggcccggtgatgcacaacagcttcctgtaccgtctgccgcacgcgttcttcagcgactggaagcgcgtgcgcgattgcgacccgctcgcgcaccgcacgctgcgcggcgcacacggccatgcggtgcggctgtcggtcgtcgagccggggctcgatgcacggtttcgcgactggtgcgtgaagtacgggctcgcgcaactgatgtgcgtgtgcacgctcgatcgccgtttcggcctgacgacattcatgtcgatctaccgtcagggcctgaaccgtccgttcagcgatgacgatgcacgccgtttcgaggaagtgattccgcatctcgcggcggcgctgacgatcaatcgcgctgcgcagctcacgcgcgagcgcggcgatgcagttgcgccggccgcccgcgcgttgtgcgacaacttcggtgtgctgcaccacgccgatcatggtttcgacgacgtgctgcgcaccgaatggccggcatgggccggtgcacgcgtgccggaaccgctcgttgcgcacctgcggcgccagccgggccagccgttcgtcggcgatgcgttgcggatccagtgcgtgccggttgcggggctgttccagatcgaggcgcggccgcgttcgctgctcgaccgcctgagcccgcgcgagctcgcggcgatccgctattacggcgccgggcgctcgcacaaggaagtcgcgcaacagatggcgatttcgccgacgaccgtgcgccactacctgcgctgcgcgtaccgcaagctcggcatgcacgacaagagccagatcgccggcgtgctcggcgcgacgggcggcgcggccgacgacgaaccggtggaagccggcggcgagccgcgctgacgcatgcgaacgccgtgcgtcgcacggggtgcgtgaatggttgtgcccgcaaccattgagcgttatgctcgtccgcttccaggagacggaatttcatcatgaacgacacgaattcagggtcgatgcgcgcggcggtggtcggggtcggcgcgatcggcggattgctcgcggccgcgttgtcgcgggccgggatgaccgtgagcgcgtacgcgcgcggcgcgacgctcgacgcgctgaacgcgcacggcgtgcgcgtgatcgacgaggcgggcacgacgtcgtcggttccggtgcgagcgagtgacgatgcggccgcgctcggcgtgcaggactacgtggtgatcgcgctgaaggcacaggcactgccggcattggccgcgcgcatcgcgccgctggtcgggccggacaccgtgatcgtcgcggcgatgaacgggctgccgtggtggttcacgcacgggctcgaaggcgcgctcgacggcgtgccgctcgacgcggtcgacccggccggtgcggtgtcggcggcgttgccgcccgcacaggcgatcgggtgcgtcgtccatttgtcgtcgagtaccgatgcgccgggcgtcgtgcgccgcgggcgcggcaaccggctgatcgtcggggcgcccgatgcgcggctcgatacggccgctgcccggtttgccgcggcgctcgcggcgggcggtttcgacgtcgagtcgacgccggcgatccgggccgagatctggacgaagctgtggggcaacatgaacatgaatccgctgagcgcgctgacgggatcgacggccgagcagctgctcgacgatccgttcacgcagggtctcgcgctgcggatgatggaggaggcggccgcgatcggcgcgaagctcgggctgtcgacggggatgagcgggcccgagcggatcgcggttacgcgcaagctcggtgcgttcaagacgtcgatgctgcaggatttcgaggcgggccgcgcgctcgagatcgggccgatcctcggtgtgtttcccgagctcgggcgcaagctcgacgtgccgactccgtattgcgacgcggtgctcgggttgctgcgccagcgggcgacgaacagcgggctataagtgcgggagggccgctgcatgcgcgatgccggcgaggtggcgcgctgcaatccggttgccgcgcgcaacgcatcacgcaaagcgggccgcccgcgtcgctggtgtggcgaccggggcggcccgtcgaattcatcggatcaatactgcggacgtcgtgcccgcgtgccggtcagtcgtcccgctcgatcgcgtgcgcgacgaccttgtcgagcagccgctcgaatgtctggcgttcgctgtcggacaggcatgcgagcaagccatcgttccacttgcgcacgatcggcatgatcttgcgatgcagcgcgcggccgtcggcggtcagcgcgatcaacacgatccggccatcctcctcgcttgcgctgcgttcgagcagcccctggcgcagcagcgcttcggctgcccggctcgcctggctcttgtcgagattggtgtggcgcgccagatccatgatcgagaacgggccgaaggcgccgacggcggcgatcacgcgcgcctcgggcagcgagatgtcgagcttgtgccggtacacctcgccgatcccgcggtcggatcgcttcgtgagcgcatggaggcgataggtcagaaactgatcgagcccggcttgacggcctttcatgtcgaatcctgaagaaaagggcgggcccgattgttcctgtatcgcgcgctcgggtcaacggtcagtgtgcgccgtacttcaggcgtgtcaattgctccgcttcgttcgcgagcagattggccgcgtcgcggatcgcgacgtcgagcgtgatcggcccgggagccggcgagaagcagccggaaaaatgttcggacaggcgcggcagcgcggccgggtcgaccgcgccggacagcagcgacgcgggcacgcccgcggcctgcgcgtggcggcacgcgatgaacggcgccttgccgtgcagcgtctgtacgtcggagcggccttcgccggtgatcagccagcccgcgccggcgagcgccgcgtcgagcccgacctgccgcgcgaccacctcggcccccgcttcgaattgcgcgccgagcatgtgcagcgcgaatccgaggccgcccgcggcaccggcgcccggcaggtcgcggccgcgacggtcgagcgcgccttcgagcaggtcggcgaagcgggcgagtgcggcgtcgagggtggcgacctgctcgggcgtcacgccctttgcgggccgaacacggcggttgcgccgtgcgtgcccgtcagcgggttgtcgacgtcggacatgccgatgaattcggtttccttcagccgtgggtcgagccccgacgcgtcgacgcgcgcgatgtcggcgagccgcgacggcacgggctcgaccggctggccgcccgcgtcgaagcactgcaggccgaggcctgcgagcagcccggcgcccgcgtcgttggtgctgctgccgcccagcgcgacgaagaagcggcgcacgccttcgtcgagcagcgtgcggatcgcctcgcccatcccgcgcgtgctgcgcgcgtcgaccggcacgctcatgccgaccgggtccgtgatgccgacgatctcggccgtttcgacgatcgcggtgcgcgcgtcgatcacgccgaccgccgcgtcgcgcgccgcgagcgacgcaccggctacccgcagcgtgcgccgcgtgccgccgcctgccagcatcgcgtcgagcgtgccttcgccgccgtcggccatcgggcagcagcgcacgacggcgtcgggccgggcgcggcggatgccggtggcgatcgcgtccgcgacctgctcggcggaaagcgagcctttgaacgaatcgggcgcgatgacgacgacaggcgcggacgggtgttgcggcatggtgtctccggaaggcgtgattggtgtgaagaatattggggcgcgacggcggtgcccctcattcggagcttacaggatggcaggcccgtggtggatacgccatgcggcatagcggcgatccgcgcgcattgccgtgcgaagggctgccggcgcggtgcggacgcgcgcgcgtcgcgccgatctggcggtgtgaggaaaattgtttgctagaatagtcgattcttccggccaaagccgtgctccgagccgcttgcgctagccatccggcgcgtgcagggatggcgtggcgctccggcgcggcgagtgtatgtgacgcacatcacgccgcaggcaggcacggcaaggaaaacccgattcgctcgaataattttaggacgattgaagccatggctaacgttgttgagaacctcggcaagcttgaacgccgcgtgacgatttccctgccgaaagacaccgtgcagaaggaaatcgacgcccgtatccagaaactcgcgaagaacgtgcgcatgccgggtttccgcccgggcaaggtgccgctgaagatggtcgcgcaacagtacgcgggtcaggtcgaagcggaagtgctgagcgacaagatcggccaggaattcttcacgatcagccgcgcggaaaacctgcgcgtcgccggccagccgagcttcgagccgaagcaggagcaggctgaagatgcatacgcgttcgacgcgacgttcgaggtctacccggaagtcaagatcggcgatctggcgacggctgaagtcgagcgctcgacgacgtcgatcggcgacgccgaaatcgaccgcacgctggatatcctgcgcaagcagcgcgtgcacttccacgcacgcggcgaagccggcgagcacggcgacggcggcgcggacaccgcagcgaagaacggcgaccgcgtgacggtcgacttcgtcggcaagatcgacgacgtcgcgttccagggcggcacggccgaagatttcccgttcgtgctcggcgaaggccgcatgctgccggaattcgaaaccgcggcgctgggcctgaaggtcggcgaagcgcgcacgttcgacctgaagttcccggacgactaccacggcaaggacgtggcaggcaaaacggcccagttcacggtcacgatgaagaagatcgagtggccgcacctgccggaaatcgacggtgaattcgcgaagtcgctcggcatcgaagacggcgatctcgcgaagatgcgcgccgagatcaaggaaaacctcgagcgcgaagcgaagcgccgcacgcaatcgatcgtcaagaaccaggtgatggacgcgctgctgaagatctccgaactcgacgtgccgaaggcgctgatcgagcaggaccagcaacgcctcgtcgaaatggctcgccaggatctggcgcagcgcggcgtgccgaacgcgaaggacgcaccgatcccggccgagatgttcaccgagcaggcagagcgccgcgtgaagctgggcctcgtgctggccgagctggtgaagtcgaacggcctcgaagcgaagccggaacagatccgtgcggaagtcgacgagttcgcgaagagctacgaagacccgaaggaagtggtccgctggtattattcgaaccagcagcgcctcgccgagatggaagcgttcgtcgttgaaagcaacgtcgtcgatttcgtgctgggcaaggcgaaggtgacggacaaggaagtgagcttcgaagcactcgcgagcgcatcggcgcaagcgtaagtgttgctctagcggcgtgccggctgtcggagcgacggcccgcacgccgtttttacgtcaagcgcacggttgccattaatatggcgattgagcgggcggcttccttccgttcaattttccattcgaacaaggttcattgaatgatcactcgcgctgaattgctggacatgcttgcttcgaacgcgccgcaaggtttcgaggcgcaagcgctggggctggtgccgatcgtcgtcgaaacgagcggccgcggcgagcgttcgtacgatatctattcgcgtctcctgaaggagcgcctggtgttcatggtcggcgaagtgaacgaccagaccgccaacctcgtggtcgcgcagttgctgttcctcgagagcgagaatcccgacaaggacatcagcctgtacatcaacagcccgggcgggtcggtgtcggccggcatggcgatctacgacacgatgcagttcatcaagccggacgtgtcgacgctgtgcatgggcctcgcggccagcatgggcgcgttcctgctcgcatcgggcgcgaagggcaagcgtttcgcgctgccgaactcgcgcgtgatgattcaccagccgctcggcggcgcacgcggccaggcatcggacatcgagatccaggcgcgcgaaatcctctacctgaaggagcggctgaaccagttgctcgcgcagcacacgggccaggacgtcgaacgcatcgcgcgcgacaccgaccgtgataacttcatgtcgagcgaggatgcgaaggcgtacgggctgatcgaccaggtgctgctgaagcgcccgtgagcttaagtggggtgccgccccgattcgtgcggcgccctgcgacttcccgaacgcccagagcatctgcggcaagcgcatccggtcggctccggtcgcgccctaggcgcggtgcccggagcattcggcgtatcatgtcatttacctgtccggaggctctacattcatggcggacaaaaaggttcgaacagcgagaagctgttgtattgctcgttttgcggaaaaagccagcatgaggtgaaaaaactcatcgcgggcccgtcggtgttcatctgcgatgaatgtatcgacctctgcaacgaaatcattcgcgacgaggcggctgccgccggcgtcgaggccagcctgtcccggtcggatctgccgagcccgcaggaaattcgcgacatcctcgatcagtacgtgatcggccaggagcgcgcgaagaagatcctcgcggtggccgtgtacaaccactacaagcgcctgaagcatctcgacaagaaggacgacgtcgagctgtcgaagagcaacatcctgctgatcggcccgacgggctccggcaagacgctgctcgcgcagacgctcgcgcggttgctcaacgtgccgttcgtgatcgccgatgcgacgacgctgaccgaagccggctacgtcggcgaggacgtcgagaacatcatccagaagctgttgcagaactgcaactacgaggtcgacaaggcccagcgcgggattgtctacatcgacgaaatcgacaagatcagccgcaagtcggacaacccgtcgatcacgcgcgacgtgtcgggcgagggcgtccagcaggcactgctgaagctcgtcgagggcacgatggcgtcggtgccgccgcagggcggccgcaagcacccgaaccaggatttcatccaggtcgacacgaccaacatcctgttcatctgcggcggagcgttcgacggcctcgaaaggtgatcaccgatcgtaccgagaaaaccggtatcggcttcggtgcgacggtcaagagcaagcaggagcgtgacgcgggcgaagtgctgcgtgaaacggagccggaagacctgatcaaattcggtctgatccccgaattgatcggccgcctgccggtggtcgcgacgctcggcaagctcgatgaagcggcgctgatgaagatcctggtcgagccgaagaatgcgctcgtcaagcagtatcacaaactgttcgcgatggagcgcgtcgagctggagatccggccgggcgcgctgcaggcagtcgcccgcaaggcgatccgccgcaagaccggcgcgcgcggtttgcgttcgatcatcgaacaggcgttgctcgacgtgatgtacgagctgccgacgatgaaaggggtcagcaaggtcatcatcgacgaaaacgtcatcgatggcgacggcaagcctttgctgatctatgaggacacgccgaaggtggcgggttcgaactgaccggcttgccgacgatgttctgcgaaaaaggccgttcatgagtccgtgggcggctttttcgtttatcttgtgggtaactctgactcgactcgcggtggttactttcttaccgaatatttcccgcacttgaaggcttgcaattcgttgtggcggcctcaattaccgaacaattgattccactcatggggaaatgaaatgtcaggcacccaacttcttccgccggaacgcatcacgctcccgctgctgccgctgcgggatgtcgtcgttttcccgcacatggtcattccgctcttcgtgggccggccgaaatcgatcaaggccctcgaagcagcgatggaaggcggcaagcacatcatgcttgtcgcccagaaaaccgcagccaaggacgaaccgaccgaaaaggacatgtacgaggtcggttgtatcgccaacatcctgcagatgctgaagctgccggacggcaccgtgaaggtgctcgtcgagggcctgcagcgcgcgaaggcgttgtcgatcgaagagcaggaaacgcaattctcctgcgaagtgatgccgctcgagcccgatcacgccgacagcgctgaaacggaagcgctgcgccgcgcgatcgtgtcgcagttcgaccagtacgtgaagctgaacaagaagatcccgccggagatcctcacgtcgctgtcgggcatcgacgaagccggccgcctcgccgacatgatcgccgagcgcctgccgctgaagctcgaccagaagcagcacatcctcgagatgttcccggtcatcgagcgcctcgagcatctgctcgcgcagctcgaagctgagatcgacatcctgcaggtcgaaaagcgcatccgcgggcgcgtgaagcgccagatggaaaagagccagcgcgagtactacctgaacgagcaggtcaaggcgatccagaaggaactgggcgaaggcgaagagggtgcggatctcgaggaactcgagaagcgcatcaacgccgcgcgcatgccgaaggaagcgaagaagaaggccgacgccgagctgaagaagctgaagctgatgtcgccgatgtcggcggaagccaccgtcgtgcgcaactacatcgacacgctgatcggcctgccgtggcgcaagaagagcaaggtcaacaacgacctgtcgaacgccgagcaggtgctcgacgaagatcacttcggcctcgagaaggtgaaggaacgcatcctcgagtatctcgcggtgcaacagcgcgtggacaaggtcaaggcgccgatcctgtgcctcgtcgggccccgggcgtcggcaagacctcgctcggccagtcgatcgcccgtgcgacgaaccgcaagttcgtccggatggcgctcggcggcgtgcgtgacgaagccgagatccgcggccaccgtcgtacgtatatcggttcgatgccgggcaagatcctgcagagcctcacgaaggtcggcgtgcgcaatccgctcttcctgctcgacgaagtcgacaagatgggcatggatttccgcggtgatccgtcgtcggcgctgctcgaggtgctcgatccggaacagaaccacacgttcgccgaccactacatcgaagtcgacttcgacctgtcggacgtgatgttcgtcgcgacgtcgaactcgctgaacatcccgccgccgctgctcgaccggatggaagtgatccgtctgtcgggctacacggaagacgagaaggtcagcattgcccagcgttacctgctgccgaagcagaagaagaacaacgggctgaaggaaggcgagatcgaggtcaccgagcaggcgatccgcgacatcatccgctactacacgcgcgaagccggtgtgcgttcgctcgagcgggaagtgtcgaagatctgccgcaaggtcgtgaagatgctgctgctgaagaaggcatcgggcgcgatcaaggtcgacggcgagaacctcgataccttcctcggcgtgcgcaagtacgacttcggcctcgcggcgaaggaaaaccaggtcggtcaggtgacgggcctcgcgtggacggaagtcggtggcgatctgctgacgatcgaagccgcggtgatgccgggcaagggcaacgtgatccgtacgggttcgctcggcgacgtgatgaaggagtcggtcgaggcggcacgttcggtcgtgcgctcgcgttcgcggcgtctgggcatcaaggacgaagcgttcgagaagcaggacatccacatccacgtgccggaaggcgcgacgccgaaggacggtccgtccgccggcggtgcgatgacgaccgcgctggtgtcggtgctgacgggcatcccggtacgtgccgatgtcgcgatgacgggcgaaatcacgctgcgtggtgaagtcctgccgatcggcggcctgaaggagaagctgctcgcagcgcatcgcggtggcatcaagctcgtgctgatcccggaagagaacgtcaaggatctcgccgagattccggacaacgtgaagaacgcgatcgagatcgtgccggtccgctggatcgacaaggtgcttgaactcgcgctcgagcgttcgccgacccgctgccgccggaagaagaggcgaaggcggcggcaccggtcgccgatgcggcgaaggatgccggctcgacggaattcgtcaagcactgagcatcggagcgccgttcgttctgacggttgttcacgaaacccgcggcctggccgcgggtttttatgcgtcccgaatcgtatgcgcgagcgtggaaaatattcgcgtcggggctttgcaaaatgatcggggatgaattaaacttgcgggctcgctggttgttgatgccgaaacgcagatcgcagccagaacgaatcggaaacgggtgcttagctcagctggtagagcggcgcccttacaaggcgtaggtcggggttcgaacccctcagcacccaccagtttcctgattcagccagaccaaggagcggtagttcagtcggttagaataccggcctgtcacgccggggtcgcgggttcgagtcccgtccgctccgccaaacaaacaacaatgcccgcctcgtgcgggcattgttgtttgtgcgttcggtttgcgccagatcgcgggcgcaaaccgaacgcacaaacggcggggaaatcgtctgcgcggcttccggggcgcgccgccgtcagaacggaaaatccgcgaccgctcgaacgcggtcgcgggtttttcatgctttctcgccgcagaggcgccggtctttccggctcgcgcggggcggtattacggaacgcgtattaccggcggcaacttgtaggttccgttcaggagcggggcgtccggcaagtaggtgcgcagcgtcagattgaacgcgccggcaggagccggcagccagttgctggcgggtacacccgcgggtcgcacatggctgatggtgagcacgagcgagccgtcgctcgcgaactgaaagttcgacgccggataggacagcgcatagattcgatcgggattcggataaagaaagcctgcgcctggttcgtgccggcgtacagcgtcaatgaccagaaggcgcgagcaggaggaagctgttccgccgggaacgtcatctgatagacgccgttgccgtcgtaattcgcccccgacgtgttcgccgctcccgtactggtgtagtagatcgcttcgctgccgggcagcgcaccgaggccgttcagcgcaacgcgcgcccgtagcgtgtactgggttccatagttgccgacgttggccgggccgcctgtccagccatttgcgtcggtactcgtctgggcggtggcttgctgcgttccgccgcccgtcagactcgccagcgcctctgccgcgcctgcgtcgatcgatgcgacgtcggcggacgacgcgttgaaagtctgcgccgggcctatacctgtcacgtcgagtgcgttcgtcgcctcggccgtatcctgcggcgtcggcggactctttttcaagagccggttcacgtactgaaaatacgacggccagttggcataaccgggcggcttttgcgtgtccacgctgtcccacgcagcgacaccggttccagcggggcgcgacacgaccagttgattctgaacggcccacgcggcggggtaatcgttcgcatcgctcacgtaagtccgcgccaacgcccacaccgcgttggtcgacgagcggagcacggtgacgcctgccggggcggttccctgccagttcggccccacgacccaaaagaccttcgcgacaccgttgtcggcgctcgtgccgcgaatcgcgaagttgttcgtataggcgtccatcagcgcgagggagaagtagcgggtgccgctggcaggcgtgtcgatctgaacaggacctgcgtccagttgaagcatggcgacggaatacagcgtgtcgtgattgggcttcgtcaccgaggtggacgaagcatcggacagctggcgactgtgcacaaacgtattcggcgcaaggccctgagcgatgtagctctgtcgggttgcgtagaactggtacagcggaatcgtgaatagcgtggcactgtttgcggcatttttcgtcgcgacgggcgaaacgcccgagctatcgacactttccccattgcagcccgccagaaggccgaccgaggcagcgaatgcgacgaggcgcgcgtggtgaagaaaactcatcgagtggtgcggtagggttgaatggtcgaatgggccgcacccgttcatcgtttcgtcgacgagcgtggcacggattgcacggcgcgaaaagcgtatccggcttgcgatgcggcacgaacgatctattttcgatatgcaaagtccgacgactcgttagggcggtgtcgaccgatcggcatcgtgcggttgattcttgtcgcctttccggtcgtcacgtttctcgcggcctatgccgggacgtacatctcgggcttgtgccgtgtgctcccgtgtcgggcgccttccgttggctcgattcgcggccccggcggtgccgtgtggtcgtcggcgcgaatgacgccagccccgcatcgggcaagccgctccgcgaacgagtggtcgtgtgctgccgggagcctgggcggccgcggtgggggcgatcattgggcgagctgctttccgaacttcgcgaggagaggcgggtgacggtgcgtggtcggttctgaaagacgggtatttttgcctgtacctcctgtggtgatcgccgcgggcgccgccgcttttctcccgttccaccccgtatgttgtaatatcgggcgttttgtccaattttcccgtcacgcatgctcgatttcttccgtaatcaccagcgcctgatgatggcgctcctgctcctgatcgtgttgccggggctgggtttcgtcgggatccaaggcttccgcggcttcttcgacgatagcgcgaacgtcgcggcagtcaacgggcacaagatcacgcgggtcgaattcgacggcgcgttccgccagcagatcgaccaggcgcgccaggcactcggcgggcagttcgacatcaagatgttcgatacgcccgagcaccgcaagcaggtgctcgacggcctgatccagcaacgcgtgctggccgacgagacccaacgtctgcacctgaccgcatcggacaacgccgtgcgcgacgcactgatgagcgacccgatgatcgcgtcgctgaagaagcccgacgggtcgatcgacgtcgagcgctatgcgcagctgctgtcgttccaggggatgacgcccgagcagtatcaggagcgcgtgcgctacagcctcgcgctgcagcagattccggccagcatcgtgtcgagcgcgttcacgccgaagagcctcgcgcaacgtctgtccgaactcgccgcgcagcagcgcgaagtgcaggcgctcgtgctgaagacgagcgacttcgccgcaaaggtccagccgaccgacgcgcagctcaccgcgtactatgacgcgcacaagcagagcttcgcgacgccggagaccgcgacgatccagtacctcgtctattcgccggcggcagcgaccgcgagcgcgcagccgaccgacgcggacatcaagaagttctacgatgacaacccgacgcacttccgcaccgaagcgcaggtgcgcgtgagccacatcttcatcgccgcaccgggcagcgcaagcgcggccgacaagactgcagcgaagacgaaggccgagcaactgcttgccgacgtgaaggcgcacccggaccagttcgcgcagatcgcgcagaaggactcgcaggatgcaccgtcggccgcgaagggcggcgacctcggcttcatcacgcgcggctcgacggcgggcggcaaggcgttcgacgatgccgcgttcgcgctcaagcaaggcgatgtgagcggtgtcgtgcagtcggatctgggcttccacatcctgaaggcaacggaagtgaagccggcggccgtcaagccgttcgcggaagtgaaggaccagatcgcagccgacctgaagcagcagtacgcatcgaaggcgttcacggacaacgcggaaggcttcacgtccaccgtctacgaaaaggcgaagacgctgcaaccggccgcggacaagtacaagctgacgatccagacggctaccgtcacgccgacgccgaatccgcagttgccgccgacgagcccgctgaacaatccgaagttcctggccgccgtgttcgcaaacgactcggtgaagaaccagaacaacacgcaggcgatcgacgtcggcaacaacacgctgatctcggcgcgtgtgaccgactacaagccggctgccgtgcccgcgctcgacgcgatcaaggacgtcgtgcgccagaaggtggtcgccgagcaggctgccgaactcgcgaagaaggacggcgcggcgaagctcgccgaactgcagaagtcgaagtcgaccgacgggttcgcggccgcgcagaaggtatcgcgtacgcagtcgcagggcctgacgccggctgcgctgagcgccgtctacaaggtcgatgcgaagacgctgccggcctacgtcggtgtcgatctcggcgcggacggctatgcgatctatcgcgtgaacgcggtgatcccgggttcggcggtcgatccgcagcaactggcggccgcgcagcagcagatggcgcaggttgacgcgcagagcgaaggcgaagcgtatctcgccgcgctgcgcgatcgctcgaaggtgaagctgtacggctcgacggccagccagtcgccggacggcgacaactgagcgtcgtttcgcacgcaacaaaagccccgcttcacgcggggctttttgttttccggcgaggcggcgtcagccgcgcggcttgccgagcagcggtttcagcgccggccagacgttgtcgagcagaatgccctgggcctgctgcgctggatgcatctggtcggcctggaacatctcgggcttgttctcgatgccggccagcaggaacggcacgagcggcacgccgagatccttcgacagccgcgtatagacggcgtggaacttctgcgtgtagtccgggccgtagttgggcggcacgtacatgccgaccagcacgaccctggcccgcgcttgccgcgcaccggcgatgatgtcgcgcaggttctgttcggtcgtcgcgagcggcacgccgcgcagcgcatcgttcgagccgagctcgacgacgacgatcgacggcgagccgctgcagcaccgcaggcagccgcgcgcggccgccgctggtggtgtcgccgctgacgctggcgttcgcgacgctataatcgattcgctcggtcgtgagccgttgccgcagcaacgccacccagccggtgtcgcgcggcagcccgtattcggccgacaggctgtcgccgagcacgacgatcacgggctggcccgatgtcgcggccggtgtcgtcgcggcgcgtgcgggcacggcggcggccagcagcgtacccagcagcgcggcgatcgccgcgcgtcttttccagcgaaatgtcgtgtccatgttcaagattaccgatccgatcatcgaagtccatgacgtgtgcaagcgggtcgccgacgcaaccggcgagctgacgatcctcgacggcatcacgctcgccgtgcggccgggcagcagtctcgcgatcgtcggcgcgtcggggtcgggtaaatcgacgctgctcggcctgcttgcggggttggacagcgcgacgagcggcacggttcgcctgctcggtcgcgcgctcgaccagctcgacgaggacgcgcgcgctgcgctgcgcaacggcgcagtcgggttcgtattccagtcgttccagttgatgccgcacctgacggcgctcgagaacgtgatgctgccgcttgaactgcagggcggcatcagtgcgcgcgatgccgccgatcgcgcccgggcgctgctcgtgcaggtcggtctcggcgaacgcaccgcgcattatccgaagctgttgtccggcggcgagcagcagcgcgtcgcacttgcgcgcgcattcgtcacgcgcccggcgatcctcttcgccgacgagccgaccggcagcctcgatgcggccacgggccatgcggtcatcgacctgatgttcgaactgaaccgcacgaacggtgcaacgctcgtgctcgtcacgcacgatgccgaactggcacgccgctgcgcgacgacggtaacgctcgacgccgggcgcatcgtcgagccgcgcgcggcgcagcgcaacggctgaatgcatttgccggccgcgcagcgtgcgccgagcggccggcatgggcatgacgccgctgcgtcagtgcctcacagtgcctcagcgcttcaacgccgcgcgggcgcgctcgatcagcgcggtggtcgacgagtcgtgcttcgccggatcgaccgactcggccgacaggtcggcttccaccaccttgccgagaatcttgccgagctcgacgccccactggtcgaacggattgatgtcccacaccgttgcctgcacgagcaccttgtgttcgtacagcgcgatcagcgcgccgagcgtgcgcggcgtcagcgcatcgacgagcagcgtcgtcgtcgggcggttgcccgggaacgtcaggtgcggcgcgagcgcttccttgcccggccccgcgaccttgcgtgcttcctccagcgtgcggccgagcatcagtgcctcgctctgcgcgaagcagttcgcgagcagcttcgggtggtggctcgcgagcggatgctcgggcgtcagcaccgcgatgaagtcgatcggcacgatcgtcggcccctggtgcagcatctggaagaacgcatgctggccgttggtgcccggctcgccccacgtgacggccgacgtcgggtagtcgacgaaggtgccgtcgaggcgcgcggatttgccgttgctttccatttcgagctgctgcaggtacgacggcaggtagtgcagcgcttccgaatacggcgcgacgagatagctctgcgaaccgaagaaattccggtaccagatgccgatcaggccgagcagcacgggcaggttgcgctcgagcggcgcctcgcggaaatgacggtccatgtcgttcgcgccggccagcagctcgtcgaactgctcggggccgatcgcgatcatgatcgacagcccgaccgccgaccacagcgaatagcggccgccgacccagtcccacatttcgaacacgttgtccgcggcgatgccgaacttcacgacttcggccgggttcgccgacacgccgacgaagtgctttgcaagcgcgtcctcggggcagccgcgcgcgacgaaccagtcgcgcagcgagcgtgcgttcgtcatcgtctcgagcgtcgtgaaggtcttcgacacgatgatcgcgagcgtttcctcgggatcgacctgttcgagtacgcgtgcgagatcggcgccgtcgacgttcgacacgaagtgcgtggaaatttcgggcgtcgcgacgtggtgcagcgcgtgcacaaccatcttcggcccgagatcggagccgccgatgccgatgttgatcacgtggcggatgcgtttgccggtgtagcccgtccaggtgccgctgcgcacggcgcgagcgaacgtcgccatcttcgcgcgctcggcgctcacctgcgcgtggaacggcgcttgcggatcggtcgcgcgcagcgcggtgtgcagggcggcacggccttcggtcgggttcacgatttcgcccgcgaacatcgcgtcgcggcgcgcctcgacacccgcgtcgcgcgcgagctggacgagcaggcgcagcgtttcgtcgttgatgcggttcttcgagaaatcggccgcgagaccgccgcccggaatcgtgaagcgttcggcgcgggtcggcgcgcggtcgtgttccggcgcgaaccagtcgcgcagacgggcgtgacggatctgttcgaagtgggattgaagggcagtccaggcggggagcgaattcagcgtcatggcggttcgagtgaagcgtgaatcgggaggaatgccgcgccggctcatcgggatcggaaggccggcggacgagagggccgccgtgcggcgggcagtcagtatagcggcgttatgtgccggcgcgcggcgacgcataaaaaggcgattgaccagcgtgcgcaccatcggcgcgagttcgcctgccgtgagtccggccgggccggttccgttcgcggtcagcgtgtcggccgcgaggccgtgcagatagacgcctgccagcgccgcttcgtacggcgcgacgcgttgcgcgagcagcgcgccgatcaggccgccgagcacgtcgccggtgccgcccgtggcgagcgccgcgttgccggtcgggttgatcgtcatgcggccgtcgggcgccgcaatcaccgtgcccgagcctttcagcacgacgatggccgcataacgtgacgcgagcgcctgcgcggccgcgaggcggtcgcgctgaatcgccgccgtgtcgcagccgagcagccgcgcggcctcgagcggatgcggcgtcagcacgcacggataaccgcgcgcgccgcgcgtggcgacggcggccgcgagatccgcatgcgtcgcgacgaggttcagcgcgtcggcatcgagcagcgttgcgacgtcgtgggcaagcacgtcgcgcacgagcgtcgccgcggcctcgcgcgtgcccagcccgcagcctgcggcgatggcggtcatcgcgccgaggtcgagggtgtcggccgcgtgcagcatcagttcggggaacggcggatcgtacggcggcgcgccggtgccgaggaagccgacatgcaccttgccggcaccggcgaacagcgcggcgcgcgcggccaggatcggcgcgccgcacatgccggtgtcgccgccgagtaccgcgaggctgccgtacgtgcccttgtgggacgcgaatgcgcgcgcgggcagggcggcggcgaaccgcgcgggcgcgttcagtacgatggccggcgcggcgggtggcgcgacgtcgagcgattcgacgtcgatcgcgccggcgagatcccggccttcgccggtgtagaggcccggcttcgcgccgatgaaagtgagcgtgtgggtggcggcgacggcgacgcccgcgccgacgatctggcccgtatcgctgtcgagtccgctcggcacatccagcgcaagcacgcggccgccgctgcgcgcatgcgcggcgatgcgcgcggcctgctcggcgaacgcgccgtcgagcgcgcggccgagaccgatgccgaacagtccgtcgaccacccacgcatagccgtccagcgaagcaggcggcgtggccgacagcggcacgccggcggcgcgcgcgaggccgagcgcccattgcgcgtcgtcgggcttcaccggcaccggcatccacgcctgggtcgcgacgccgagctgctgcaggtgcgcggcggcaacgagcgcgtcgccgccgttgttgcccgggccgaccgcgaaccacacggggcggtcgtcgccggccgcgcgttcggacagccagcgcgcggcggcggcgccggcgcgacccatcagcgtatgcggcggcagcgccgcggctgcgtcggcttcggccgtgcgcaggtcggcgacgcgcagcagcgcgatcggagcggaatcgggaagcggaagggtaacggtcatcgcgggttcatcgccgggtcgcggcggctggcaaggcggccgccggggacgggccccgcggcggtcaggtcgtgaagcgcccggcgcttagcgcggcgagcgtgtcggcgcgccagtgctgcacgtcgccgcccaggtagtcggtcaccactttagcagacccgcatgcgagccccagccggccgggccatgcccgaaattgacgaatacacgcggatgcgggtcggaccgacgaccggcaggccgtccggcgacagcagttgcgtgccttgccaggacagcgcggccgagatcctcgcggcacccggcacccagtcgtggacggcctggccgagcaatgcgagcgcggcctcggacagcggctcggcgagcggcttcgcggtgtcgggcaggctctgcagcacggcgccgccaccgacgcgcagccgctggtgggtgcgcgtgatcgagatgcgcttgatcgaatcgatgacgttcaggtgcggcgcatgttcttcgtaggcgaccggcgcggtcagcgcatggacccgcaccgggtgcagcggcaggcgccagccgaggcggtcgagcagcggcaggctgccggcgccggcggcgaccacgatcgcatcggcggaaatcacgtcgacgtcgcgggcgttcgacgcgtggcgctcgccgggcgggacgagctcgaccgcggcgcggccgttgtcgacgcggatcgcggcgacttccgcgccgaagcggaactgcacgccgtgctcgtcgagcgtctgcttgaccagtttcgcgaacagcgggcaattcccggtgcgctcggtctcgagcagcacgccgccggcgaaaccgggctcggccggcaccgacggctcgagtgccgcgcattcgtctgcggagagcaggcggtacggctggtcgagcgtgcgcagcaggtcgagcgcgggctgcatcgcttcccagtcgcgcggatcgcgcacgacgtgcaggatgccgggcttctgctcgaactcgagctcgaggcgcgtctcgatgtcggcgagcgcgtcgcgcgacgcgtcgatcagcggccgcagccgcgtgtactgcgcggcgaacgcgtcgggctcgcgcagcctgccgagctgcttgacgaagcgccgtacgccgccgttgaagccgggcttgtagacgatgccgctgtcgcgcggctggcgctggcgcatgaaggtcgggccgaaccagacgtcgagcgggctcggcagcagcgcgccgccgtcgccgtaggtcgcaccctgcgcgacggtcgcgtggcgttcgaccacgcatacgcgatggccggccgcgcgcaactggtaggcggtggcgacgccgctgattccgccgccgatgacgatgacatccatggattgcttcgatgacgggcggcgcgcaggcgctgcccggtgagaattcgctgagggcccgggcccggtgaacccggaatgatagcgccaaaatcgcgggaaccggcgccggggtggcacgggccgtgccgccgtgccgcggccgccggctgccgcgcccgcgcggggcggcccggcgggcaggccgtgcgcggtggacatcgcggcaccgatgcggtgcatgcgggttgccgatcggccggtcttgggcgaccgacttccgggtataattacggccttcctttcgccccacgtcgccacctcgcgcgactcatcgacgtcagtccagcccatggctcacttctcgtgttttcccggcgcttcggccctctccgatttccgtcaaacccgtctgctcgacacgctcaggcaaatcgacgccaacatcgtcgcggtgcgcgggcagttcctgcacttcgtcaatgcggccgagccgctgtcggccgacgacagcgcgcgcatcgatgcgctgatgcactacggcgcgccgttcgagccggcggccgagaagggcacgaccgagaccttcgtcgtgctgccgcgtttcggcacggtttcgccgtgggcgagcaaggcgaccgacatcgcccagcactgcggcctcacgcacgtgcgccgcatcgagcgcggcgtcgaattcacggtcacgctgaagtcgggcctgctcggcggcaagaaggcgctgtcggacgacgcgcgcgcggccgtcgcggccgcgctgcatgaccggatgaccgaaagcgtggtcgcggcgcgcgacgacgcgcagcacctgttcgacgaactgccggccaagccgctctcgaccgtcgacgtgctgggtatcggccgcggcgcgctcgagcgcgcgaacgtcgagctgggcctcgcgctcgccgacgacgagatcgactacctggtcgacgcgttccgcaagctcgaacgcaacccgaccgacgtcgaactgatgatgttcgcgcaggcgaacagcgaacactgccgccacaagatcttcaacgcgcagtggacgatcgacggcgaagcgcaggacatgtcgctgttcgcgatgatccgcaacaccgagaagctgagcccgcagggcacgatcgtcgcctattcggacaactcgtcgatcatggtcggcgccgaagccgaacgctggttcccgcgcaacgcaggcgcggccggcgagccgggcgagcgctacggccgccacaccgagctcacgcacacgctgatgaaggtcgagacgcacaaccacccgacggcgatttcgccgttcccgggcgcggcgaccggcgcgggcggcgagatccgcgacgaaggcgcgacgggccgcggcgcgcgtccgaaggccggcctgacgggcttcaccgtgtcgaacctcgacctgccggacgcccgccagccgtgggaaaacgcgcgcgacgccgcgcagccggtggccgagcgcaacccgagcgagcagcacggcccgtacggccgtccggatcgcatcgcgtcgccgctgcagatcatgatcgacggcccgctcggcggcgccgcgttcaacaacgaattcggccgcccgaacctcggcggctacttccgcgtgtacgagcagaacgtcggcgggaaggtgcatggctatcacaagccgatcatgatcgcgggcggcctcggcaacatagcggatcagcatacgcacaagcgcgacgtgccggccggctcgctgctgatccagatcggcggccccggcatgcggatcgggatgggcggcggcgccgcgagctcgatggcgaccggcgcgaacacggccgaactcgacttcgactcggtgcagcgcggcaacccggaaatcgaacgtcgcgcacaggaagtgatcaacggctgctggcagctcggcgcggaaaacccgatcctgagcatccacgacgtcggcgcgggcggcctgtcgaacgcgttccccgagatcgtcgacggcgcgggcaagggcgcgcgcttcgaactgcgcaaggtcgcgctcgaggaatcgggcctgtcgccgcgcgaaatctggtcgaacgaagcgcaggagcgctacgtgctggcgatcgcgccggccgacctgccgcgtttcgaggcgatctgcgcgcgtgaacgctgcccgttcgcggtggtcggtgtcgcgaccgacgaacgccagctgaagctcgtcgacgacgaagcgacgggcgccaacgaatacccggtcgacatgccgatggaagtgctgctcggcaagccgccgcgcatgcatcgcgacgtcacgcgcgtgacgaccgagcgtgcgccggtcgacgtgacgggcatcgcgctgtcggaagtcgcgatcgacgtgctgaagcacccgacggtcggcagcaagtcgttcctgatcacgatcggcgaccgctcggtcggcggcacgtcggtgcgcgaccagatggtcggcccgtggcaggtgccggtggccgactgcgcggtcaccgcgctcgactacgcgggcttcaagggcgaggcgatgacgatggccgaacgcacgccgctcgcggtgatcgacgcgcccgcatcgggccgcatggcggtcggcgaggcgatcacgaacatcgcgagcgcgccgatcgcgtcgctcgacaagctgaagctgtcggcgaactggatggccgcgtgcggcacggccggcgaggacgccgcgctgttcgacacggtcaaggcgatcggcatggagctgtgcccggcactcgggatcggcatcccggtcggcaaggactcgctgtcgatgaagacgaagtgggacgagcagggcgtcgcgaaggaagtggtgtcgccggtgtcgctgatcatctccgcgttcgcgccggtcgaggacgtgcgccgtcacctgacgccgcaactgcgccgcatcgccgatgcgggcgacagcgtgctgatcgcgatcgatctcggccgcggcaagaaccggatgggcggcagcatcttcgcgcaggtcacgcagcaggtcggcgacacgacgccggacgtcgacgatgcggaagacctgaagcgtttcttcaacgcgatccagtcgctcaatgcgcaagacaagctgctcgcgtaccacgatcgctcggatggcggcctgtgggcgacggtgtgcgaaatggcgttcgcggggcacgcgggcgtgtcgctgaacgtcgacatgctgacgctcgacccgaatcacgaatccgactacggcgacgcgaaggactgggcgaagcagacgagcggccgccgcgaggatcgcacgctgcgcgcgctgttctccgaggaactgggcgccgtcgtgcaggtgcgcgcgaccgaccgcgacgcggtgctgggcgcgctgcgcgagttcggcctgtcggcatgctcgcacgtgatcggctcggtcaacgatcgcgacgtgatcgaggtgtaccgcgacgcgaagaagattttcgacgcaccgcgcgccgaactccatcgtgcgtggagcgaagtgagctggcgcatcgcgcgcctgcgcgacaaccccgcgtgcgcggatgccgaatacgacgcgctgctggacgtggccgacccgggcatctcgccggtgctgagcttcgatccggccgacgacatcgcggcgccgttcatcgcgacgggcgcacggccgcgcgtagcgatcctgcgcgagcagggcgtgaactcgcatctcgaaacggcctacgcgttcgaccgcgcgggcttcgatgcgcacgacgtgcacatgagcgacctgctggccggccgcgcgaatctcgccgatttcgcgggtgcggtcgcatgcggcggcttctcgtacggcgacgtgctgggcgcgggcgaaggctgggcgaagacgatccgcttcaacgcgaatctcgccgacatgttctcggcgttcttcgcgcgtcccgacacgttcgcgctcggcatctgcaacggctgccagatgctgtcgagcatctcgtcgatgatcccgggtgcggaagcctggccgaagttcacgcgcaacaagtccgagcagttcgaggcgcgtttctcgttcgtcgaagtcgagaaatcgccgtcgatcttcttcgcggggatggaaggctcgcggattccggtcgcggtcgcgcacggcgaaggttatgcggacttctcgcaacagggcgacatcgatcgcgtcgcggtcgcgatgcgcttcgtcgaccaccgcggcgaagcaaccgagcgttatccgttcaacccgaacggctcgccggccggcatcacgtcggtcacgacggccgacggccgcttctcggtgctgatgccgcacatggagcgcgtgcatcgtacggtcgcgatgagctggcacccggaaagctggggtgaagcgagcccgtggatgcgcgtgttccgcaacgcgcgccgctggatcggctgatcgggatgatgttcgatccgaacgcgccggtcgaggtcgtcacgctgcgcgacgagcgcgcgagcgaggccgacgcgatcggccgcgtgatcgtcgccgcgttcgcgggcgagccggaaggcgggcagttcgaacggcggatcgtcgacacgttgcgtgcggacggtgcgttgagcgtctcgctcgtcgcggaacgcgacgaccgcctgatcgggcacgtcgcgttctcgccggtgtcgatcggcggcgaggcgcccggcagccagggctggtacgggctcgcgccgctcgcggtgctgcccgactgccagcggcggagcatcggcacggggctggtgcgcacggggctcgacgcgttgcgccgcctcggtgcgcgcggctgcgtcctgctcggggagcccgcgtactacacgcgtttcggctttgcgccgtccggcgacatcatgttcccgggcgtaccgcccgagtatttccttgcgctgtcgctcgacgactcggcgccgcggccgtcaggcaacgttcgctatcacgacgtgttccatcccgcgtaagtctgcggcgcgagccgatcaggcatatggcaaaggccgctcttcggagcggccttttctttggtgggaacgccgcacatcgcgatgcgcttgcggccggcctgcgggcactgcgggcaacaaaaagccgctccagggagcggcttttcgatgcgcgagcggcgagcgcctgcgttactggatctttgcctgctggcgcagaccttcctcgaacgcctgcagcttctgctgcacgagctgctgcgcgatctgtgccttcacctgatcgagcggcggcggcgcgatgtcgcggatgtcgtcgacgcggatgatgtgccagccgaactgcgtcttcaccggcgtgtcggtcatctggcctttctgcagcttctgtgcggccgccgcgaattccggcacgtacgccttcgggtcggaccagtcgagatcgccgccgttcttgcccgagcccggatccttcgagaactgcttcgcgagatcctcgaacttcgcgccggccttgatcttcgcgatcaggtccttcgcctgctgctcgtcgctgacgaggatgtggtgcaggtggtattcgcggttgccgccggcgcccttgacgaggtcgtcgtagcgcgccttcacttcggcgtcggtcggctggttcttcttcaggaaactctcgatcatcgaacgcagcacgacggtctgctgcgcgacggcgacctgcgccttcacgtccggacggttcgggatgccttcacggattgcttcctgcatcaggatttcgcggttcacgagttcctggcgcacggcctgctgcagctgcgggctgtcggtctggccttgctgcacgagctgggcgaccatcgcgtccgcgcgcgacttcggaatcggcgtgccgttgacgacggcgatgttctgggcaaatgccggtgccgctgcgaaagcagccgccgcgacccacaggcgggggatttcaggatcatcgggaattcctaatgagactagattgaagattcgttgaattcttcgggcgtgtaagccacgatcgcgagcgcgtgaatgccgcgctgcatcgcatcagcgagcgcatcatacaccagccggtgccgcgcgacgcgcggccccgcgaacgcggccgacacgatcgtgaccgtgaagtggccgccggcggccgcgccgacgtggcccgcgtgctgcgcgctgtcgtcgcgcacggtgagcgacagcggggcgagcgctgcggtgaggcgcgcttcgatcagcgcgatgcgttcgtcgggcgacgcgtggagaaaggcgtccgtcatgtcactcgtccttcaggtatttcgtgagccacaggctctgcaggatgatgaatacgaccatcgcgcccgtcgtgccgaacagcttgaagttcacccattgcgactcggtgaagttgtgcaccacgtacaggttcgcgacgccgagcaccgcgaagaacagcgcccacgcgacgttcagtttgtcccacacggggtgcggcagcgtgagctgcttgcccatcatcttctcgatcaggttgttgccgaacgcatagcgcgcggcgagcagcccgatcgcaaacagccagtacagcacagtcggtttccattgaatgaatttctcgtcgtgcaggacgagggtggcaccaccgaaaacgacgatcacgcccaggctgacccacagcatcgtgtcgaccttccggtgccggaaggcgacccacgcgacctgggccagcgtcgcgacgatcgcgacggcggtggcggtaaagatgccccagaccttgaaggcggcaaaaacaggatgatcggaaacagatcgaacaggaatttcatggcgctcgcagctgcgtgaaggccgcttgcgcggccttccaccgttgtagggacccgccaggcaccgccggagcggatcggggcggcggcgcgggatgccccgccgatccgcccggcgccgctcattcgttttcgggtcgggactcgaagtttaacgcagccgaattgatgcagtagcgcaaaccggtcttgtcgcgcgggccgtcctcgaagacgtggccgagatgcgcgccgcagtggttgcagcggacctcgacgcgcaccatcccgtgcgagtagtcgaccttctcgtcgatcacctcgccgttgagcggcttgaagtagctgggccagccgcagcccgagtggaacttggagccggattcgaacaatggcgtgctgcagacgacgcacttgtagatgccggcgtcttcggtgtcggtgtattcgccggtgaacgcacgctcggttgccgcatgctgcgtgacttcgtactgcatcggcgtgagtcgccgccgcagctcggcgtcgtccttctggtacgggaaggtcttgtcgtcggaatcgtgggacatggggttctcctgatcggtcggtcgatacgcgcgggttgcgggcttcaggacgagcagctcacttcgagcgacccggcccagtcgggcggcaacgccgcgtacgcttcatgctccggttgttcgtcgaacggccggcgcaggatctgcgcgagccgctcgacctccgaaaaatccttttccttcgcgcgccggatcgcgacttcggccagatggttgcgcaacacgtatttcgggttcgcgcgattcatcgcggccgcgcgtgtcgcgtcgtcgcgcgtttcctcggacagccgcgcgcggtagaggttcgcccacgcatcgaacgcgtcgcggtcgatgaacaggtcgcgcacgggtgcgtcgcggctcgcgtcgtgcttcgagacctgtgcgagccggcggaacgtcagcgtgaaatccgcgtggctcgcatgcatcgtctcgagcagcttgttcgcgaggtcggcatcgttctcgcgttcgagctcgaggccgagcttcgcgcgcatcgcgcgctcgagcgcggggccgaaacgttccgggaacttcgcgagcacggcctgcgcgtcgtccaccgcgcgctcggcgcgcgcatcgtcgtcggcgatgccgtgctgcagcccgatcagcggcagcagcgcctgcgcgaggcagtagcagttccagtgcgcgatgcgcggctgcatccggtacgcgtagcggccgttcgtatccgagtggttgcagatgtggttcgcatcgaacgcatcgacgaaaccgaacgggccgtagtcgatcgtcacgccgaggatcgacatgttgtcggtgttcatcacgccgtggcagaagccgacggcctgccactgcgcgacgagatccgccgtgcgcagcgtcgccgcttcgagcagcgcgaggtatggatcgtcggcgtggcggcaatccggatagaagcggtcgatcacgtgatcggcgagctggcgcagcaggtcggggcgatcgttcgagaagaagtgttcgaagtggccgaagcgcacgaagctctccgacacgcgcgtgacgacggccgacgtctcgatttcctcgcgcaccaccggctggtcggaaccgatcaccgtcagggcgcgcgtggtcgggatgccgaggtgatgcatcgcttccgagcacaggaattcgcggatcgacgagcgcagcaccgcgcggccgtcgcccatccgcgaatacggcgtgcggccgctgcctttcagctgcaattcgtagcggcggccgtcggtgccggtgcgctcgccgatcgtcagcgcgcggccgtcgccgagctggcccgcccacacgccgaactggtggccggaatacaccgatgcgtacggcatcgcgtgcgcgggccagtcgcgcgtcgggttgccggcgaacagctcggcgaagccgggctgcgcggcgagcgacggcggcaggtcgagcaggtgcgcgacttcgccggaaaagccgacgacgtacggcgcggcaagcggcgcggccggcagccgcgtatgaaacgcgtcgccgagcgcgacgaacgcgccggcggcgggcgcgccgagcgtggcggcgaggtcggggagggtgtcagccgtatcggctgcgcttcgggaaaacgacatgttgagcgcctctgggtaagccgatattgtaaggcggcgccgcgccgcccgcatggcggcccgcgcgccatgcgcgacgcccgtccggggccgctgacgggcgcgccgcagaggctggtcaccgattcgcatcctcacggagaacaagacgatgggtaagccgttgctgggccagatgatggacatgccgttgctggtgtcctcgctgatttctcatgccgcgcgacatgccggcgacacggagatcgtatcgaggcgcgtggaaggcaatctgcatcgctacacgtaccgcgattgcgaacgccgcgcgaagcaactggcgcaggcgctcgcgcggctcggcgtcgaaaccggcgatcgcgtcggcacgctggcgtggaacggctaccggcatctggaagcgtattacgggatcggcggcatgggtgccgtgtgccacacgatcaacccgcgcctgttccccgagcagatcgcgtacatcgtcaatcacgcggaagaccgctacgtcttcttcgacctcaatttcgctccgctcgtcgatgcgatcgcgccgcagtgcccgcacgtgaagggctgggtcgcgatgacggacgccgcgcatctgccgtccggcacgacgccgttcctgtgctacgaaacgcttgtcgaagcggaggacggccgctacgactggccgcgcctcgacgagcagcaggcgtcggggctctgctacacgtcgggcacgaccggcaacccgaagggcgtgctgtattcgcaccgctcgaccgtgctgcacgcgtacggcgccgcgttgccggacgcgatgaacctgtccgcgatggacgcggtgctgcccgtcgtgccgatgttccacgtcaacgcgtgggggctgccgtacgcggtgccgctcacgggcggcaagctcgtgctgcccggcaaggatctcgacgggaaatcgctgtacgagctgatggaagccgagcgcgtgacgttctccgcgggcgtgccgaccgtgtggctcggcctgctcaactacatgcgcgaagccggtgtgcgcttctcgacgctgaaccgcacggtgatcggcggctccgcgtgcccgcccgcgatgctgcgcaccttcgaggacgaatacggcgtgcgcgtgatccatgcctggggatgaccgaactgtcgccgctcggcacgctcgcgaagctcaactgggcgcagtcgcagcggccgctcgacgcgcagcgcaagctgctcgagaagcaggggcgcgtgatctgcggcgtcgacatgcgcatcgtcggcgaggacggccacgagctgccgtgggacggcgtcgcgttcggcgagctgcaggtgcgcggcccgtgggtgatcgaccactactttcgcggcgatacgtcgccgctgtcggacggctggtttccgaccggcgacgtcgcgacgatcgaccccgacggcttcctgcagatcaccgaccgcagcaaggacgtgatcaagtcgggcggcgagtggatcagctcgatcgacatcgagaacgtcgcgatcgcgcacccgggcgtggccgaggccgcctgcatcgcctgtgcgcacccgaaatggaccgagcgcccgctgctcgtcgtggtgccgcgcgaaggggcgaacctgaaccgtgacgcgctgctcgcgttctacgaaggcaaggtcgcgaaatggtggattcccgacgacgtcgtgttcgtcgactcgctgccgcacaccgcgaccggcaagctgcagaagctgaagctgcgcgagacattccgcgattacgtgttgtcgacggcggtcggcgagtcgtaacgcgagccgtaacgtctgcgcccgggccgcaagcggctcgcgaaacggtcgcccgatccgtccccggatcggcagcaaaattcaaattgaacgaccgtgctttttcgttgtatgctgcctgcgttcaaccggacatgcggctgttcgaccgcgcacaatgaagcgcagccaccccggcgcgcgatgcatggaggcaggcagatggcagtggattactcgactcgcgacggcgtggccgtccttacgctcaacaatccgcccgtcaacgggctcggcctgtcgacccgtcagggcgtcatggacgcgctcgatcgcgccgcgcaggacccgtcggtcacggccatcgtgctgaccggcgcaggacgcgcattctcgggcggcgccgacatcaccgaattcaatacgccgaaggcgctcaggagccgacgctgcacaccgtgatccgcgcggtggaggcgagcgcgaagcccgtcgtcgcggcgctgcacagcgtcgtgatgggcggcggcctcgagctcgcgctcggcgcgcattaccgtatcgcggcacccggcgcgcaggtcgcgctgcccgaggtgaagctcggcctgctgccgggcgcgggcggcacgcagcgcctgccgcgtgcggtggggctcgaaaccgcgctgaacatgatcgtgtcgggcgcgcccgtgccgtcggagcagctcgcgaagagcgggctgttcgacgagatggccgacggcgacctgctcgacgcggctgtcgcgttcgcgcgcaaggccggtgcgcagaaggggccgcatccgcgcgtgcgcgatcgcaagatcgtccacgcgaacgccgcgggcttcatccagttcgcgcgcaactcggcccgggccgccgcaccaaatttccccgcgccgcacaagtgcatcgacgcgatcgaggccggcgtgctgcgcggcttcgacaagggcagcatcgccgagcgcgagggtttcgtcgcgctgatgatgacgccggaaagccgcgcgctgcggcatgcgtttttcggtgagcgcgcggcgagcaagattcccgacgtgccgtccgatacgccgctgcgcgagattcgccgtgtcggcgtgatcggcgcgggcacgatgggcggcggcatcgcgatgaacttcgtgaacgcagggctgcccgtcacgctgctcgaaacgaaacaggaagcgctcgagcgcggcgtcgcgacgatccgcaagaactacgacgcgcaggtgaagaagggcaagctcacgcaggagaagctcgacgcgcgcatggcgctgatcacgccgacgctgtcctacgacgacctgaaggatgccgacctgatcgtcgaggccgtgttcgaggaactcggcgtgaaggagcaggtgttcaggaagctcgacgaagtcgcgaaggcgggcgcgatcctcgcgtcgaacacgtcgacgctcgacgtcgacaagatcgcggcattcacgaagcgtccgcaggacgtcgtcggcatgcacttcttcagcccggcgaacgtgatgaagctgctcgaggtcgtgcgcggcgcgcagaccgcgaaggacgtgctcgccaccgtgatggccgtggcgaagaagatccgcaagacggcggtcgtgtcgggcgtgtgcgacggcttcatcggcaaccggatgatcgagcagtacatccgccaggcgctcttcatgctcgaggaaggcgcgctgcccgcacaggtcgatcgcgcgatcgagaaattcggtttcgcgatgggtccgttccggatgagcgacctcgccggcaacgacatcggctgggcgatccgcaagcgccgctatgtcgagcagcccggcctgcagtactcgaagatcgccgaccgcctgtgcgagcagggccgcttcggccagaagacgggcgccggctggtacgactacgtgccgggcgagcgcaaggcaaagccgtcgtcgctcgtcgacgagatggtcgtcgcgtattcgaaggagcgcggcgtcgagcggcgcaagatcggcgacgacgagatcgtcgagcggctcgtgttcgcgctggtgaacgaaggcgcgaagatcctcgaggagaagatcgcgtcgaaggcgtccgacatcgacatggtctacctgaccggttatggcttcccgctgtggcggggcggcccgatgctgtacgcggacgtggtcggcctctacaacgtcgagcgcgcgattcgccgctacgcggccgcgccgaacggcgacgcatggcaactcgcgccgtcgatcgcggcgctcgcgaaggccggccgcgggttcaacggctgacgcgccggatcacggcgcgacgaacacccggagaaacgcaatgagacacaccgacgacgtgctgctcgtgatcgacgtgcaatacgacttcatgccgggcggcgcgctcgcggtgcccgacggcgacgcggtcgtgccggtgatcaacgcgctggcgcagcgcttcgaccaggtcgtgctgacgcaggactggcacccgcgcgagcacgtgtcgttcgcggcgaaccatccgggccgcgaaccgttctccacgctcgcgctgccgtacggcgagcaggtgctgtggcccgtgcactgcgtgcaggacaccgacggcgcggcgctgcatcgcgacctcgacatcccgcatgcgcggctcgtcatccgcaagggcggcgacgcgcaggtcgacagctattccgcattcgtcgaagcggatcgcacgacgcgcacggggctcgcgggctatctgcgcgagctcggcgcgaagcgcgtgtggtgctgcgggctcgcgaccgactattgcgtcgcgtggtcggcgctcgacgcgcgtgcggccggtttcgacgccgcggtgatcaacgatgcgtgccgcgcgatcgacctgaacgggtcgctcgcccacgcatggcagcagatgcaggcagcgggcgtcgcgcatgtgacgtccgcgggcgcgcgcccggcggcgtagcgcatttccccattcgatgcaggacatgaagcaggaccgaaggagactcgcatgaccgaagccgtaatcgtatcgaccgcccgcacgccgctggcgaaatcctggcgcggtgctttcaacatgacgcacggcgcgacgctcggcggccacgtggtcgcggccgcgctcgaacgcgcgaagctcgaccccgcgcgcgtcgaggacgtgatcatggggtgcgcgaaccccgaaggcgcgaccggcgcgaacatcgctcggcagattgccttgcgtgcggggctgcccgtgagcgtgccggggatgacggtgaaccgcttctgctcgtcggggctgcagaccatcgcgctggccgcgcagcggatcatcgcgggcgaaggcgaggtgtacgtcgcgggcggcgtcgaatcgatctcgtgcgtgcagaacgagatgaaccaccacatgatccaggaaggctggctcgcgcagcacaagcccgagatctactggaacatgctgcagacggccgagaacgtcgcgaagcgctacggcatctcgaaggagcggcaggacgagtacggcgtgcagtcgcaactgcgtgccgcggccgcgcaggaagccggacgctttcgcgacgagatcgtgccgatcacggtgctcgcgggcatcgccgacaaggccacgggccgtctgttcacgaaggaagtgacggtatcggccgacgaagggatccgcccggacacgacgctcgaaggcgtgtcgaagatccggtcggccgtgcccggcggcgtgatcaccgccggcaacgccagccagttctcggacggcgcgtcggcctgcgtcgtcatgagcgccgatgccgcgcagcgcgaagggctgcagccgctcggcgtcttccgcggtttcgcggtggcgggctgcgagccggacgagatgggcatcggccccgtgttcgcggtgcccaagctgctgaagcaggcggggctgaaggtcgacgatatcggcctgtgggaactgaacgaagcgttcgcggtgcaggtgctgtactgccgcgacacgctcggtattcctgaggatcgcctgaacgtgaacggcggcgcgatcgcggtcggccatccgtacggcgtgtcgggcgcgcgcctgacgggccacgcactgatcgaaggcaagcggcgcggcgtgaagtacgtggtcgtcacgatgtgcatcggcggcgggcagggcgcggccggcctgttcgaaatcctctgatctttggcgggcggcggccgcggcttcgcttcggcgaggcaggcggccgcgatgcgaatcggcgcgactgaaccgccattcgaaacaatcgggaagcaaaggcgtgcgccgggcaatgccgtttcccttacttgtcaaacaatttgccccacctatacttgctctgacatttgcctttcggcacgatgggccggatcgtgcgtcgcacgatccgtgccgcgaaggttcgaaccaacgcagcagaccgaccggggaccgaatgagtacgacctatgcagccggggaaccgccgcgcgtcgtcagcgcggccgcgaggctctacgcgaaatgcctgctggtcggattcgcgttgctgcccgcctatctgatcgcctatctgtggttcttcagcgacccgcacgcggtgttcgagaaccacgcgttccatgaaatcgcgatcgcggccgcgaccctcgagggcgggttcgttacctacgtgacgtgggtgtgctaccggtcgtccggcgaaccgctgctgcgctggctgacactcggctttctcggcttcgcgatgatctacgcgctgcacggtgcgttcaccgggatggcgcatcacaatatctggctgttcctgctgtacgggcccgcgtcgcggctcgtgatgtcgatcctgctgctcacgggcctgctgtcctatgcccgtccgcccgatcgcttcgacaagcgcacgagcgtgcgcacgtggctgccgtggatcgtgttcttcgtgatcgtcaacgtcgtcgtggcgtacatcgcgtattcgccggtcgcgggcgcgccgggcacgcggctgtcgatggaaggcggcgcgctcgtgttctcgctgctgaacgtcgccgtgctgctcgcgcggcggatccgctcgccgctgatggtgatctacggcgtgtcgatcatggcgtttgcgctgtcgtcgctggcgttcattctcggcaagccgtggaatcacatgtggtggctcgcgcacgcgattttcgcgggcggcttcttcctgctcagctacggtgtcgtgcaggcgctgcagacgacgcgctcgttctcggcgatctacagccaggaagacctgatgagccggctgtcggaatcgatggcgcgcaccgagagcgcgctgcaggaactgcggcgcacgaaccagaagctcgaatacatggccgcgaccgatccgatgacgggcgcgtcgaaccgccggcagttcatcgcgcaggtcgagcgcgagatggtgcgggccgagcgcgacggcacgccgttctgtctgctcgcactcgatctcgacaatttcaagaacatcaacgatgcgtacgggcaccagatcggcgacgaggtgctgcgcggcgtcgtgcgtcagtgcctcgacgcgatccggccggccggcgggctcgcgcgggtcggcggcgaggagttcatggcgctgctgcccgagatgccgctcgaaggcgcgcggatgacggccgagcgcgtgcgctcgtcgatcgcgagctcgccgttcgggctcgatttcaagcgcgtgcaggtgacggtcagcgtcggcgtcgcgcaatacggggtcgacggcagcacggtcgacgcgttgctgcgcgtggtcgacgaacggttgtaccaggcgaagcgggaagggcgaaaccgcgtcgtgtcgcggtgacgcggggtggtgcggcacgccggacgttcggcaacgcggcggtgccaacggcgtgtcgatcgtttcggtttctgcccaagccccgggcgaggtaacgtacccggggcttcagcgtgcccggtcggcacgcgacgggcgatacgcagctagcgcgatgccagggccgccgcgttttccggctgcgcatcctgcatctgccgcgacgcctgccaccaatacttgcccgcgcgctgttgcggatcgcggatcgcgagatacgtcgtactccagagctgtgccgcgttggcttcggtcgcatcggcgctgcgcgtgccgaacgcgtcggtctggtacttgccgttcacgtaggaccacgtccacatctccgacgtccgcatgtcgcgcccgttcgagatcacctgccagatcgtctgccgcgcctgcgcgagcagcgtgcgggtcgcggccgacaggtcctggcgtgcgagctggcgatcgagcccggccacccacatcgcctgctgccacgaccagatcaccgtgccgtgatacgcggaactcgtgaatttcggccacagtgcctggctcgcatacgcagggttcgcgatcagcatgccggcatcggtcacgagcccggtcgggaacggccgcgtgacgtcggcgacgatccgctggagctggtcgtccggcggtgtgccgaacagcaacgcgaagccgccatcggagttcatcaccggaatcgggttgccctgctgatcgagcgacagcgcgtaaaggccagcggtgcgccaggcgcggcaccggccggcacgccggcggacggcgcataggccgacacgtcggcggtcgcctgcgcggccggcacgctgacctggaacagtggcggcgcctgcgtttcccatgtggccgcctggttagccgtgttagcgagcgtcgcgcgctgtccggcatccaggtacggatcgagcaggccgcgcgtgaggaacgcgttcgccgcgcgcaacgcggccggcacgagcaccgcgttcacgtcatacgggtagacgccgccgccgagcccgtcggtgctgtcgcgccagttgccgacgatctcgccgggccgcaggtggatcaggttcgcgaccgacggctgctgcgcgaacggctgcgcggtgttcgcgacatgcagcaggttgacgaccaggcgggcgccgttggtcttcccgtcgctgccgcgctgggccagatacgcagccgcacgcgcctggccgcgtgtatcgtcgatcagccacgcggccgcgatcggcgcgagcaggtagtcgctgtcgatcatcttgtagtcgtaggtcggcgtcggatcgttcggtttcccgttcttctggttgtcgacgagtgcgaactcgccgatgccttcctcgtgcgcgaccttgccgtcggccgacagccggctcagcaccgacgacaggccggcctcgatcgccgcgggttcgagcacgggcatcagcatgcgaaccgagatcagcgtgtcgcggccgaagtaggtgtcgtactgccacgagcccgccagcagcttgtcgtggaagctcaggaattcgagcacgttctggctcacggggtcggggttcaccgacggcgcgagcaggtcggcgcgcgtgatcggcgacaacggcgtctcgcccgacagcgcatcgacatgcagccgcagcgtgtgcgagcccgccggtgcgctcaggacgagcttgccgcccgcagccggcacgatgctgccgccgtcgcgcaacgtgatgcgcagcgaatagccgggcgcgccgtcgatccggtcgcgttgccattgcgcggcgctgccctggaccgtcggcgcggcgagaatctgttgcggaatcgttgcgccgccgttgaagtcgcgcaggaagcgcacgttgctgagcacgccctggcggatcgtcagcgtgccggtgtccaccgacacgtcggcgccgatgccgtacagcgggcggccgtgcgcgtcgggtgccgacagcgcggacggcggcgtgtcgaggctccagttcaccggctgcgcggtgtcgtcgaaccacagccccgtgccgctgttgccggcggggaagaccacgagcaggcgcggtttcgtcgacgagcgcaccagcaggtgcgcggcgaccttgtcctgccggtagaacgcgttgatctggccgccggcgtccatgcggaacgacagcgcggcgttgttcgacggcgggctgttcgattcgacgttgtcgtcgttgcaggccgcgagcaggccggcgcagatgaatccgaggcacagcgacttcacaaggcgatgcatgttgatgtccctcctgatgactggcgatttttatcgggatggtcgaatgaacggatctgttgtccgtttggtaccgtgtcgcgggcattcaagtgaatgccgggtgttaatcaggatgtgatgctgttgcggtgagtgaatcgagcaggaaattggcaaacaggcgataaatgccgaaagctgaaacggcaagggacgccgccccgacgtgaagcgagaaaaggcaaggcggacggcgttcgtgcaggtgcgtgccggcttgtgtgcggcgggagaaaatcaatcgtaagccgctgtaggggattctaaattttcggaagaatcgaagtcaatgacgttttcctgatttcaggcggttttgcgaaaaatcgatcgtaactattactcattgaatcggtaaattatgcgatttaatgaaggcgggtattggaatccggatattcggtgaataaataatcggcaatgacgtttcattttgccgattgctgtcgtgccggaattgaatcgtcgagtttgcgcgggcgattgccgaggcatgcaggcctgcgccgaagcggcgcgcgcgaagccgggcaagccgcgttcccgcgattcaatggaaggctacgcgatcgttccatcggagccttcaagtttggtaggcttggcgattgccgccgcttgcgcggatcgcgccgtcggtgagcgacacggtgaaaatgcgcgtatcgtcgccggaaaggccggacgacagccgattcgatacgcgtttttccccgttgccgcgaccgcgtgcaagcgaagcgggccgagcccgcttcgtgaacatcaacgaacaggagcaaccgaagtgatccgacatatcgtcatgtggaagttgaaagaatcggccgaaggcgcgacgcgcgcgcagaacgcgctgaagctgaaggaaaagctcgaaggctgccgcgacctcgtgccgggcacgctgcagatcgatgtcggcgtggcaacgcccggcctcgacgcgaccgccgacatcgtgctcgtgtccgatttcgcggacaaggccgcgctcgatgcctaccaggtgcacccggttcaccaggaagtgaagaaattcgtcgtcgcggtggccgagtcgcgcgaatgcgtcgactacatcgtcgacagcgcacgatgagcgacgcggcaaccccgacggacggcccgtcgatcgaaagcccgttcgtcgacctgctcggcgtgcagctcgtgtccgcgaaggacggggcgagcgagctcgtgctgccgctcgaagagcggcacatgaacacgtggagcatcgcgcacggcggcgtgacgatgacgctctcggacatcgctctcgcgatggccgcgcgcagcctgaccgacgacggcgtcggcgtcgtgacggtcgagatgaaggtgaacttcatgcaaccggggcgcggcgagttgcgcgcttacgggcgcgtgatgcatcgttcgacgacgatggcctactgcgaaggcgaagtgcgcgacagcgacggcaatttcgtcgcgaaggcgctcggcacgttcaagtacatgcggcggctcgcggtgggccgcgacatcaagcggcaacgctcgcgcacggcgccggacgcccagcccggcccgagcgacgcgtaagcgccggaacgcacggccctgccgctttgccggcagggccgttttgtttcacggcgcaggtgtgccgtcgaacgcgttcacggcaggccgagagagggccgggattgcgcaccgcgcctgcacgacgagggcgtggcatcatgtgacgcttgtccgttcacggcgtcgcaccggcgccgtccttatcgatgccgctgaatccgaaaatcgcccaggtgctcgacatgatcgagcgcgcgaaacgtccgtcctaccatcaccagacgccgcagcaggcgcgcgccgcgtacgagaagagcgcgccgatcctcgacgtcgcaccggcgccgatgcattcggtcgaggagtgcgtggtcccgacgcgcgatggccgcacgatcggcgcgcggctgtacctgccggtcccgccgagcctcgcggagccgctgccggcgctcgtgtactaccacggcggcggtttcacggtcggcagcgtcgatacgcacgacgcgttgtgccggatgttcgcgcacgacgcgcagtgcgcggtgctgtcggtcggctaccggctcgcgccggagcaccggttcccgaccgcggtgaacgacgccgacgacgcgttgcaatggctgcatcgcgaggccgccacgttcggcatcgatgccgagcggctggccgtcggcggcgacagcgcgggcggcacgctcgcgaccgtctgcgcggtgctcgcgcgcgatgcgggcattcgcctcgcgctgcagatgctgatctatccgggcgtgacgggctaccaggacaccggatcgcacgcacggctcgcgaacggctacttgctgacgcaggacacgatccagtggttcttcacgcaatacgtgcgcgatcggtcggaccgcgacgactggcgtttcgcgccgctcgacggcacgcgcgatgcgccgtcgttcgcgggcgtcgcaccggcgtggatcgcgacggccgaatacgatccgctgagcgatgagggtgccgcgtatgcagagaagttgcgtgcggcgggcaatgcggtcacgctggtctgctatccggggatgatccacgaattcttcaagatgggcggctacatccccgaggtgcgggccgcgcatgccgatgcggtcgcggcactgaaggccgcattcgacgacgtttgacggcatttgacggcgcgcgcgccgcgtggagggctgcgatgacggacggcgtggtggaaacgggcgactggacggtgctgggcggcgacgccgcgcggatccgcgacgcggtgttcgtgcgcgagcagcagattccgccggaatgggagctcgacgacgacgatccgctgtcgctccatgcggtggcgtaccgggtcgatgccgcgaccggcgtgcgccgcgcggtcgcgacggggcggctgctgccgtcgggcacgatcggccgcgtcgcggtgctggccgatgcgcgcggccagggcgtcgggtcggccgtattggacgcgctgctggacgcggcgcggcgccgcggcgaaatcgtcgtgcggctctatgcgcaggattcggccgtgtcgttctacttgcggcacggcttcacggcggtcggtgaaccgttcgtcgaagccggcgtgccgcacgtcgagatggcgcgggcgccgtagcacggcgcccgcacgcgtgctcagcgcggcggggtcgcgtcgaggtcgaacgtgaacgcgcgctcgaacgaacccggccgcacggtacggtgcgaaccgtcgtcgtcgcagcgctccttgatctcgaccgtgagccgcacgccttccttcatcgtgacgcgcagcgcggtcgtgccgcgcgtgccgtattcgggcgtctcgatgaacgcggccgacagcgcacgctcgcgctcgatcggaatgccggtgtgcggcagcgcgtcgtcggccgcgacatgcgggtcgcgcatcaacgcgatcaggtcgtcgagcgacggggtcggattatcggtaagcagcgtgccgagttccgcgcgtttgcgcaccactttcggccagggcgtatcgagccgcgcattcgacagcgcatgcacgccgggcgcgatcgcgatgggggcggcgacacggctttcgccttcgggcgcacgattgcagaaccacgcgagttcgcgccgcctccagtcgccgacgagcaggttgaagccgttgtagacggccgcatgctcggccagctgcccgagatagtcgagcggcgcaacggacgggccgccgaggaaatcggacacgagcttgccgcgggtcggcgcgccggcgcggatgtcgaacggcgcgcggtagttcgtcagcgcggcgaaccggccgtcgcgcgagacgccgagccacgtgccgcccgcttcgagatcgcggccggccagtacgcccgggacatcttcccaccacgaaaccggcgcgctcgtgcggcgaaagaactcgtcgcggttggcggtgagggtaaagacgggaccggcggcggcatcgggctgccagtcgaaggcaatcagacacatcgggcgaatctctcgcaggaaacatcgggcgccggctgcgactcgcgagccggcgcacgaacgggttgtcagtgcgtcacgcttccgtcggccatgcgtacggcagcgcgtcgaacgcgagcaccgggccgtcggccgaaccaaggtgcaccgtgccgttgtcgagcgcggcgagcttgatctcgacgagcgcgtcgatgccgcccgcgggcgcggccgccgcgttgacgatcatcccgcacggctggccgggatcgtcgctgtggaacagctcgacgccggcatgcacggtatcggtctcgccggcgacgtgcgcgagcgccgtgcggcgcttgatcgtgccgcggtactggctgcgtgcgacgatttcctggcccgggtagcatcccttgcgaaagttaacggcgccgatcacgtcgaagttgaccatctgcggcacgaactgttcgacggcaggctgtgtgatgcgcggttcgcccgcgcggatgtcgagccagtcccatacggccggcgacacgaccggcagcgtaccgccgagcgcggcgacgcgcgcgtcgacttccgcacgcgggccgatccacagatagcgcttgcggccggctgcatcgggcacgcggatcagcgtgccggccgggccgtcgaccttcacgtgcacgccgtccggcagcgcgtcgaagatgcccgacagcgcgtcgcgcacgtcgcccgcgaagccgaccaccgcgagcgtgtcgctcgcgtccgtcagtttcgccttcgcgcgcagcacgaacatcgacagccgcttctgcacggcgggctgcacgtccttcgacaccagcaggcgcacgccgtggccggcgcgccacgcgaggaacgacccgaggaggcgcccttcggcgagcaatagccggacagccgcgcgctcgcggcgtcgagatgctcgatgtcgttggtgagctggctgtgcaggaacgtcgcggcgtcgtcgccggccacgtcgatcacgccgaactgcggcagcggcgtgcaggcgcccggcgcgtcgaaatcggcggcggacgggcggggaaaacggggagcgaggcagatgcggcctgggcagccggtgaagcgaacggtgtgctcatggaatgagggaacagtcaaccctgactttgacgaaggcgagcaagtattatatgggtcttacctgagtcacgtttccatgtccctactgaagaaatgcgccgcgacgatcgtggcgctggccgtcgttgtggccgctgccggcgcgggcggcgggtattactgggcgacccggccgctgctgctgggttccgcatcgctcgacgtcacgatcaagccgcgcagcagcgtgaagagcgtcgcgctgcagctcaggcgcggcggcgtgccggtcgagccgctcggcttcgtcgcgatgacgcgcgtgctcgggctgtcgagccggctcaagtccggcaactacgaattcaagaccggcatcacgccgtacgaggtactcagaagatcgcgcgcggcgacgtgaacgaatacgtcgcgacggtcatcgaaggctggaccttcaagcggatgcgcgcggaactcgatgcgaaccccgatcttgcccactcgacggccggcatgagcgacgccgagctgctgcgcgcgatcggcgcgtcggacaacgcggtgcaacgcggcagcggcgagggctgttcttccccgatacctacctgttcgacaagggcacgagcgacctgaacatctatcggcgcgcataccatctgatgcagacgcgtctcgacgaggcctgggccgcgcgcgtgccgggcctgccgtacaagacgccttacgaagcgctgacgatcgcgtcgatcgtcgagaaggaaacgggccatgcggccgatcgcgcgttcgtcgcggccgtgttcgcgaaccggctgcgcatcggcatgccgctgcagaccgatccgtcggtgatctacgggctcggcgacgcgtacgacggccgcctgcgcaagcgcgacctgcaggccgacactccttacaatacctacacccgacgcgggctgccgccgacgccgatcgcgttgccgggcgtcgccgcactgcaggcggcgatcaatccggcccagacgagcgcgctctatttcgtcgcgaaaggcgatggcacgagcgtgttctcggacacgctcggcgaccacaacaaggccgtggacaagtacatacgaggtcaataatggcgagcggtaaattcatcacgttcgaaggcatcgacggggcggggaagaccacccacctgcaatggttctgcgaacgcctccagggcaagctggccgcggccggccggcaggtcgtcgtcacccgcgagccgggcggcacgcagctcggcgagaaactgcgcgagatcctgctgaaccagccgatggatctcgagacggaagcgctgctgatgttcgctgcgcgtcgcgagcatctcgcgctcgtgatcgagccggcgctcgcgcgcggcgactgggtcgtgtccgatcgcttcaccgatgcgacgttcgcgtaccagggcggcggccgcgggctgccgcgcgacaagctcgagacgctcgagcgctgggtgcagggcggcttccagcccgacctgacggtgctgttcgacgtcgcgccccaggtcgcgagcgagcggcgcggcgccgcgcgcatgcccgacaagttcgaaagcgaatccgacgcgttcttcgcgcgcacgcgcggcgaatacctgcggcgtgcggaagaggcgccgcaccgtttcgcgatcgtcgacgcgacgcggacgattcccgagattcgccagcagctcgagcgcgtgctcgccgcgctgtaattcgcaaggaacgcaccacatgatctatccgtggcagaccgacgactggaaccgcctgcagcaactgcgtgcgcaatggccgcacgcgctgctgctgcatggccaggccgggatcggcaagctgcagttcgcgcagcatctcgcgcagggcttcctgtgcgaatcgccgcagccgaacggcgagccgtgcggcgcctgcgcggcctgcacgtggttctcgcagggcaaccatccggactaccggatcgtgctgcccgaggcgctggcgggcgaggcgccgggcgccgcggacgacccgaaagcggccgacgcggacgaaggcggcaagaagacccgtgcgccgagcaaggaaatcaagatcgagcaggtgcgcgcgctgctcgatttctgcggggtcggttcgcaccgcggcggcgcgcgcgtcgtcgtgctgtatccggccgaggcgctcaacgtcgccgcgtcgaacgcgctgctgaaaacgctggaggagccgccgtccggcgtcgtgttcctgctcgtgtcggcgcgtatcgaccgcctgctgccgacgatcatcagccgctgccggcagtggccgatgaccgtgccggcgcccgacgcggccgcggcctggctcgcggcgcagggcgtcgagcatgcggacgcgctgctcgccgaggccggcggcgcgccgctcgccgcgctggcgctcgcgagcgacgagaaccgcccgctgcgcgactacacgctcgggcagctcgcggccggtgcggcatgcgacccgttcgcgtgcggcgagacgctgcagaaactgccggtgccgctggtgctcggctggctgcagcgctggctgtacgacctgctcgcgcagcggatggcgggcgcgccgcgctacttcccgatgcatgcggcggcgctcgcgcggtgcgcggaagcggtcgatgcgaacgcgttcgcgcgtttcatgaaggccgtgacgcggcagcggacggtcgagaaccatccgctcaacgcgcggctcgtattcgaggaattgtttctcgggtaccgggaaatcttcgcgtgatccggcattgtttcccgtgggttgcgaaacgatgaccggctcacgccgcgacgcgaccgtggccggccggcccgcgaacgccgcccgttgccggatgccggcgcgcgcatgagcgcgcgccttacgaattcaggaaacacgatgttcgtcgactctcactgccatatcaatttcaagggcctggccgaccgcctgccggccgtgctcgagaacatgcgcgagcacgacgtcacgcacgcactgtgcgtgtccgtcgatttcgagacgctgccggaggtccttgcgatcgcggacgcgcacgacaacgtctatgcgtcggtcggcgtccatcccgatcacgaggacgcgcgcgagccgacactcgcggagctcgtcgagctggccgcgcacccgaaggtcgtcgcgatcggcgaaacgggcctcgactactaccgcctcgaaggccgctcgatcgccgacatggaatggcagcgcgaacgctttcgcacgcacatccgcgcggcgaccgcgacgatgaagccgctgatcatccacacgcgctcgtcgtcggaggacacgctgcggatcatggccgaggagcgcgcggacgtgccgggcggcgtgatgcactgcttcaccgagccgtggccggtggccgagcaggcgctcgcgcagaacttccatatctcgctgtcgggcatcgtcacgttcaagaacgcgaccgacgtgcaggacgtcgcgcggcgcgtgccgctcgaccggctgctgatcgagaccgactcgccgtacctcgcgccggtgccgtatcgcggcaagccgaatgaacctgcgtacgtcagccatgtcggacgctttatcgcgtccgagcgcgggatcgccgtcgaggcactggccgacgcgacgacgcagaactttttccggctgttcaagatcgcccgctaacgacgtgcgcgcagccgacaacccagggaaggagcccacaacaatgacgaagccgaccaaccatctgccgaaacgtgcactcgttgccgccgcgctcgtcgcgagcggcctgttcgcggcagccggcgcgcatgccgaatcgctcgacgcgatcgtcaaggccgtcaagttcgacgacatcgccgacatcggcaagcagctcaagagcggcaagctcgacccgaacacgatcgcgccgaatggcgacccgctgatcgtgatcgccgcgcgcgagaagtccgacaaggtcgcggcggcgctcgccacgacaccgaacgtcgacctcgagaaggaagacaaggccggcgaaaccgcgctgatgctcgcctcgctgaacggcgacctcggccttgcgaagctgttggtcgacaagggcgcggaagtcagcaagaagggctgggcgccgctgcactacgcggccaccaacggccaggacgcggtcgtgaagctgctgctcgaccacgacgcgtatatcgataccgcatcgccgaacggcacgacgccgctgatgatggccgcacgcggcaaccatgcgtcgacggtgacgctgctgctcgaccagggcgccgatccgcaggtgaagaaccagctcggcatcaccgcgctcgaattcgcgaagcactacaacgcgccggacgcgatcgagatcctgagcaagcggacgacgcgcatcggggcgtcgacgccggcagacgcgcaaaagagtgcaaaataacggttttcggtgcggcagacggtgcccgcccggccggatgccggccggagcagggcatcccggcgccgcgccggccagggcagcaggcggtctcgggccgcattgacataaggaacaccatgttgcgcgcaatgttttgtgccgcggcgtttgccgtgccgttgtcggcggcggctttcacgggcgcggatctcgaccggctgtgcgcgaagacggacgtcaagtcgcgggcgtcgtgcgcggcctacatcgaaggcgccgccgacggcgtctacaacaccatcgatgcgatcggcggcacgacggggccgcgggtcggccagtatttctgcctgccgcccgacatccgggcgcagcagatgaccgacgcggtgcgcaagtacatcgcggaaaatccgaagctggccgactacaacgcgagcaccgcggtgtcgctcggtctcggcaaggcgtttcctgcaggagcggcaactgacctgacgccgtgtccgggcacgcgcgtggcccggacgtcgccgacgcatcccaggacgaggcatgcacgcctcatcacccaagggcgccgatgatttcaatcgaggaactgcagcgcatcgccgatgcgccgctgcattcgtggctcggcacgctggccgtgtcggtcatcgtcatgctggtcgtcacggtcgtgcaccgcctcggcgcacgcatcgtcaagcgcctcgcgcagccgtatccgctgatgagcgcgatcctgcgctacatcgacaagccgtcgctcgttgtgctggcgctgctggcgctcgagttcgtgtgggtccaggcggacgacggcatgtcgttcgtgcgcggcatgcgcaccgcggccgcggtcggctcgatcgtgtcgctcacgtggctgctggtgcggctcgcggccggcgtcggcgacgcgatcatccaggcgcatccgatcgatacggccgacaacctccaggcgcggcgcatccatacgcaggccaaggtcctcgtgcggaccgtgatggtgctgatcgtgatcatcggcaccggcgccgcgctgatgacgttcccgaacgtgcgccaggtgggcgcgagcctgctggcgtcggccggcgtcgcgggcctggtcgccggtatcgccgcgcggccggtgctcggcaacctgatcgccgggctgcagatcgcgctcacgcagccgatccggctcgacgacgtggtcgtgatccagggcgagtgggggcgcatcgaggaaatcaccggttcgttcgtgtcggtgcggctgtgggaccagcggcgcctcgtcgtgccgctgcaatggatcatcgagaacccgttcacgaactggacgcgcagcagctcggagatcatcggcacggtatacctgtcggtcgactaccgtacgccgctcgcaccgctgcgcgaggaactcgcgcggctcgtccatgcggcgcccgagtgggacggccgcgtgcaggtgctgcaggtgaccgacgcgacggagcgcacgatgcagttgcgcgcgctcgtcagcgcggccgacgcgtcgtcgtgctgggacctgcgctgtcgcgtgcgcgaagggttgatcgcctatctgcaggaccgctatccgcaatgcctgccgcgcagccggatggaactgtatccgcacgattccgcgccggatgcgccgaatcccgaacggccgcacgcgcgcgccctgccgccagtacggcggccaacaccgcggccgacccgcaggccgtcgaaggccgctgaacgcggctctcccgccatcgtcatgaccgtgctgaaaacgcttgccatcgccaattaccgctcgctgcgcgagctgatcgtgccgctcgcggcgctcaacgtcgtcacggggccgaacggcagcggcaagtcgagcgtgtaccgcgcgctgcggctgctcgccgacaccgcacagggcgcgtgatcccgtccctcgcgcgcgaaggcgggttgccgtcgacgctgtgggccggccccgagcgtttctcgcgggcgatgctggatggcgacgcgccggtcaccggcacggtgcgcaaggggcccgtgagcctgaagctcggtttcgcctgcgacgatttcggttattcgatcgatctcggcatgccgattccgagccactcgcagttctcgctcgatccggtcgtcaagcgcgagtgcatctggggcggcgcggtgctgcgcccgtcgacgctgctggtcgaccggcagggcgcgcagatccgtgcgcgcaccgcgaccggcgactggcagacgattccgcagccggtggcgagcttcgacagcatgatgaccgagttcgccgatccgaccggtgcgccggaaatgatcgcggtgcgcgaacggatccgttcgtggcgcttctacgaccatttccgcaccgatgcgcaggcacccgcgcggcagtcgcacgtcggcacccatacgccggtgctcgcggacgacggcgccgatctggccgccgcgctgcagacgattcgcgaaatcggcgacggcgcggcactcgatgcggcgatcgacgacgcatttccgggcgcgtcggtcgagatcgacaatccgggcggccgtggccgctttgacgtgctgatgcgccagccgggctgctgcggccgctcgcggcggccgagctgtcggacggcacgctgcgttacctgctgctcgcggcggcgctgctgacaccgcggccgccggcgctgatggtgctgaacgaaccggaaaccagcctgcaccccgatctgctgccggcgcttggccgcctgatcgcgcaggcggcgcagcgttcgcaggtgctggtcgtgtcgcacgcggcgcggctcatcgcgacgctcgagcgcgaggccggctgcgaatcgctggtgctcgacaagcagctcggcgcgacggggctcgtcgacgcggacacgcgcgacctgccgccatggaagtggccgtcgcgctgacgggcggcgcggcgtgcgttcgggtgcgatcgtcgtgtcggggccatatcggcccggcaggcggaatgtatcctgcctgtaacaacacccataaagtgaaagacgggcggttccgggcaaccggatcgcgaataatgaggagatatccggcgggcgctgcatcggggcgagccgcgcgcgaaagcgcaagggcccgccggccgtgccgcaacggacaggacacaggagacgtggaccatgagaattgcccagatcgcgccgctgaccgaatcggtgccgccgaagctgtacggcggcacggagcgcgtcgtgtcctacatcaccgaggcgctcgtcgagctcggtcatgacgtgacgctgttcgccagcggcgattcgacgacgcgggcgaagctcgagccggtctggccgcgtgcactgcggctcgactcgtcgatccgcgaccgggtcgcgccgcacatgctgctgatggagacggtcgcgcgccgcgcgaaggacttcgacgtgctccatttccacatggattactactcgttctcggtcttcaaccggcaggaaacgccttacgtgacgacgctgcacggccggctcgacctgcccgagcagcagccggtgttcgacacgttcaacacggcgccggtgatctcgatttcgaactcgcagcgccagccgctgccgcaggcgaaatggctgacgaccgtctaccacgggctgcccgagacgctgtacatgccgcagcccgtcgagccgcgctatctcgcgttcctcggccgcatctcgccggagaagcgcgtcgacacggcgatccgcatcgcccgtcagtgcgggttgccgatcaggatcgccgcgaaggtcgatgcggccgaccaggaatacttcgagcgcgagatcaagccgcttttcgcgttgccgcacgtcgaatacatcggcgagatcgccgatcaccagaaggccgagttcctgtcgggcgcgcatgcgctgctgtttccgatcgactggccggagccgttcggcctcgtgatgatcgaggcgatgtcgtgcggcacgccggtgatcgcgttcaatcgcggcgcggtgcccgaagtggtggacgagggcgtgtcgggtttcatcgtcgaggatgaaatcagcgcggtggccgccgtgaaccggctgcacctgctgccgcgcgcgcgcgcgtgcggcagcgcttcgaggcgcgcttcacgtcgcgccgcatggcgcagcagtatgtcgacgtctaccagtcggtgatccgcgcacagaaacgctcgcgcttcaaggtcatcgactcgacgacctgacgcgcgtcgcgcgcggataaaaacggcgatgcccgcgaggacatcgccgtttgtgcgtggcccgcgcgcggtgcgcacgggcggcacgccagcgtcagatcttcagcttcgagaccttcgtgccgttgatcgacacgtcgcccatcaggcccgcgttcgtcagcacgacgacctggaccggtgcggtggccgtggtcgtgtcgaccgcgccgttcgcgcccatcttcacgagcgcgaccgacgcgccggcgccggcggcccagccgtccgagccgcggaattcgtcgagcgcttcctgcgtcatgaacaggaacacgatcgccttcgactgcgcaccggcctgcaggccgaccgacagcgacgacgtgttgtagtagccgaccgtgctgccgccgacgcgcagtgcgccgttgccggactggccgccgacgatgaagccggcctggatcacgtccgggaagacaagcacgccgcgcgacttcgcgacgagttcccgcgaacccttgaccgtggagtacatgcgcgacagcgtggcgtcgacgctcgagtcgattgcctggcgcttcgacgcgttggtcgcggcgttgtccggcttgtccggggtggtggtgcaaccggtaagcgcgaggctaccgacgatgagcgcagcggcggctttcagcacaagattccgtttttgcatcgttcttctccatcggatgacgttcggagtgagtctcgctcagggagcggatcacgtcggcagttatatcacaatggattacaccccttttcgtccgcgcaacaaaagcgtcaaatcgcgcgagggtgtcgcggcgtgccaacggacgatccggcgcccgcgcgccggggcggggcggcatgcgggcgcagcggtcgatcgtgcggtgggtggcgcctgcggcgcgcatcagtgcgtgacgggcggaacgggtggagccggcggcttgatcggcgggcggcgcagcacgcggcggatcagcgcgatcacgacgccgcacgcgaacaggaacgcggctggcacgacccagtagccgacgaacgcatgccacaggtagcccgcgagcgtattgcggcgcagcacgtattcggcgcgggccgcctgctggcgcggcgcgttggcggcgagcacgtcggccgggcagccggccgcgcgcgcctcgtcaggatccccgtggcacttcgcggcggcgccggcggcctgctgcgcatcggtgagctgccaggtggtcagcgcgagctgcaggtccgccttgttgtaggccatttcctcgcggatctcgcggacggcgacgatcgcgacgggcacggcccagaacacgatcacgatcagccagcggcggaaccagcggtgttgtctccatgccatccatgcctccgtttgacgcgcgtgcgcgtccgtctcgagggcggcccgatggcgcttcttgtacttggatgggccgcgttgcagccatcatagaagaaatcgcggcgaattgccgcaccatgtggcggcgccggcacggcgggccgggaaagcggggcgggagaggtcggggccgggcgcgtcgatgcgcgtgcaacgaaaacaaaatgccgcgcccgccgaagcggtgcgcggcattcgatacgggagcgccggaactcaggctgccggctgattgctcaggcagctcttcatgaacgccttgcggtcgtcgcccttcttgccggtggcctgcgtgttgcatgccttcatcttttcctgctgcgtcatcgccttcgcgggcttcgccgacaggcagtccttcatgaacgccttgcgttcatcgcccgtcttgccggctgcctgggtgttgcaggccttcatcttgtcctgctggctgttcgccgcgaacgcggggaagccagcatgccgccgagaagcactgcggctacgagcgattggattttcatttcgacactcccatggggtgaattgcgttttatcgacgccgtcacgacgcaccgcacgatgagcatggggccgcatcgcgcggggcgatccgattatggccaatcaatgtgaaaacaccaaaacggcacttcctataacgttgcagataccacgtccgttgacggcgcacccggccggacgatcggggcaaaccatgatgtgcggcggccggccccggccgccgtgccggaacctgccggataccggccgcaagcctttacaatcgcggccatgaatactccgaatcccgcatccccttcgtccgcggcggccctgccgcgcatcgccgtgctcgccaccggcggcacgattgccggtgccgcgcccgacgcggccagcacggccggctaccaggccggcgcgctcggcgtcaatttcctggtcgacgcggtgccggcgctcgcgtccgtcgcgcgcatcgacgccgagcaagtcgccagcatcgacagcaaggatctcgcgctgccgctgtggaacacgctcgccgcgcggatcgacgcgctgatggccgacccggcggtcgacggtatcgtgatcacccacggcaccgacacgctcgaggaaaccgcgtatgcgttgcacctggtcgtcaggggcgacaagcccgttgtgctgacggccgcgatgcggccggcgaccgcgctgtcgtccgacggcccgctgaacctgctgaatgcggtgacggtggccgcgcatccgtccgcgcgcgggcagggcgtgctggtcgcgttcaacaaccggatccacggcgcgcgcgacgtggtgaagacgagcacctatgcggtcgacgcgttccagtcgccggaactcggcgcgctcggctgggtgcaggacggccgggtcgaattcgcacgccgcgtcacgcgttcgcgcgacgcgcaactggcgatcgcggcagcgtggccgcccgtcgaagtggtcgccagctacgcgggcgtgacgcgcacggccgtcgacgcgctcgtcgcggccggcgtacgcggtctcgtcgtcgccggcaccggcaacggctcgattcatgcgacgctgcaggcggcgctggccgatgcggtcaacgcgggcgtggcggtggtgcgcgcgtcgcgcgtcgggtcggggcacgtgatgcgcaacggcgccgcgagcgacgatgcgctcggtttcgtgagcgcggggtcgctgcacccgttcaaggcgcgcgtgctgctgatgctcgcgctcgcgaacggcattcacgatcgcgacgcattgcaacgcgcgttcgatacgctgtgattcgatgacgggatgaccgacacgcgccgattgcgcggcgcgcgtcgcccatgaaaaaggcaggccgagcggcctgcctttttgcgtcagtgctgcacgaatgctcaggactgcggcggaatcacgagcttctggcccgggtagatccggtccgggctcgacagcatcggcttgttcgcctcgaagatcgccgggtacttgttcgcgtcgccatatacttccttggcgatcgccgacagcgtgtcgcccggcttcacgtcgtggtactgcacttccggatcgtccggttgcagatcgtcgtcgttgacgcccgcgacgccctgcacgttgccggccgcgaccttgaccttcgctttcgtgtcgaggtcggcgacgctgcccgacagcgtcacggtgcgcgatgcgccgtcgaacgccacggtcaggttcgacgtatcgagaccctgcgtgttgatgtagttcttgatggcatcggccgcggtctggtttgcggcattcggatcttccgctgcttgcgcgtcggcatgacccagcagtttttcacccgcctctttgataaacgaaagaagacccatcgttgcactccttgggtggttgaaaagaaaacgcgccgtgaagtggcgaaaaaacaccgcgctgggcgcggtcaccgaaagtgaccgcaagcgcggcggttttctcgaaaggcgtggcgaaagtgtaggcgttcatcgcgacgattgcatgaaaaatcgcacgctcgaacgtaaagaaatgtaatacgcgaaatccgacaggcggacacccgacgacgacgtctgaccgaccaaggcttcccggcgtcgccgggtgccgctgcggaccccaccacgccgctctcagcccagagcggcgttttcgcccgtcccgcatgccgtcggcagtgcagggcggggcgccccaccgtgatgcgcgcgtgtcccgcgcatcgatgcgaccggccgtgccggtcgcgtgtgtcattcgcgtgtccgtcatcgcgacggaccgcgcgttactgcatcatcggaagcaagccgcgccaggcggcatgcgttcagcccgccgtcttctcgatctcgaagttcgacatgatctcgagcgcacgcacgagtgccgagtgatcccacgccttgccgccgtgcgatgcgcacacgctgaacagctgctgcgcgctcgccgtgtgcggcagggcgaggccgagcttgcgtgcgccgtcgagcgcgaggttcaggtccttctggtgcagctcgatgcggaagcccggatcgaacgtgcgcttcgttatccgcgcgccgtgcacttcgaggatgcgcgacgcggcgaagccgcccatcagcgcctggcgtacgcgctccggatccgcgcccgaacgtgcggcgaacaacagcgcttcgccgacggcttcgatgttcagcgcgacgatgatctggttcgcgaccttgcaggtctggcccgcgccgttgtcgccgacgagcgtgatgttcttgcccatcttctcgaacagcggcttcgcgcgctcgaatgccgcctccgggccgccgaccatgatcgtcagcgtcgcttcgcgggcgccgacttcgccgccggacaccggcgcgtcgaggtagtcgcaaccgagcgcgttgatctgcttcgcgaattcctgcgtgtcgagcggcgaaatcgagctcatgtcgatcacgagcttgccggccgtcaggcccttcgcgacgccgtcgtcggcgaacagcacgttacgcacgtccggcgtatccggcaccatcgagatgatgatgtccgcgttccgtgcgacttcggtcgaattcgcgacgaccttcgcgctcgtgcgcaggtcgtcgggaatcgggaacgcgccgttcacgacgagctggtggtcacccttgagcaggttgcgcgccatgtgcgcgcccatgatgccgaggccgatgaaaccgatggttgccatgtgaaagtctcctataggggcgtatgcggaaagggcggatctcaggcggcgcgacgcgccgagcccggtgcgcagccggcgacgctgtgcagccagccgaggccttccgtcgtggtggtgcggggcttgtattcgcagccgacgtagccggcatagccgagccggtcgagcagcgcgaacaggaatgcgtagttgatctcgcccgtgcccggctcgttgcggcccgggttgtccgcgagctggacgtggccgatcgatgcgaggttgcgttcgatcgtcgcggccagttcgccttccatgcgctgcatgtgatagatgtcgtactgcaggaacaggttgtccgagccgaccgcgcggatcacgtcgagcccttccgacgagcggttcagcgcgaaacccgggatgtcgaagctgttgcacggctcgacgagcaggcggatgccttcgcgcttcagcgcgtcggcggcaaagcgcaggttgtcgacgatcgtgacgaacgtcttgtcgcgcgccgtgctcgccgacggaatcccgacgaggcagttcagctgcggcaccttcagcgccttcgcgtactcgatcgcacggccgacaccttcctggaactcgccgacgcgatcgggcaggcacgcgatgccgcgctcgccctggtcccagttgccggcgggcaggttgtgcagcacgaggcgcaggcgatgcgtctcgagtcgttcggcgagttcctctttcgcgtacgggtacgggaacaggaactcgacggcgtcgaagcccgcatcggcggccgccttgaagcggtcgaggaacggcacttcgttgaacagcatggtcaggtttgcagcaaacttcggcatgagctaagcctcttcggtcggtcagtcaaaaatgtcgtgcagttcagtcgagcatcgagatcgcggtcggtgcgtgctcggcctttcggcgagatcctcgaattcgttgatcgcgtcgatttcggtacccatcgagatgttcgtcacgcgctcgaggatcacttcgacgaccaccggcacgctgaattcttccgcgagcgtttgcgcctggcgcagcgccggttcgatctcctccggcttgaacacgcgcagcgccttgcagccgaggccctccgcgacggccacgtggtcgacgccatagccgttcagttccggcgcattcacgttgtcgaacgcgagctgcacgcagtagtccatgtcgaacgcacgctgcgcctggcggatcaggccgaggtacgagttgttcacgacgacgtgcacgtacggcagcttgaattgcgcgccggctgcgagttcctcgatcatgaactggaagtcgtagtcgccggacagcgcgacgatcgggcggctcgggtcggcggcacgcacgccgagcgcggcggggatcgtccagccgagcgggcccgcctggccgcagttgatccagttgcgtgccttgaacacgtgcaggaactgcgcggcggcgatctgcgacaggccgatcgtgctgacgtagcaggtatcgcggccgaacaccttgttcatctcttcgtacacacgctgcggcttgaccggcacgttgtcgaagtgcgtcttgcgctgcagcgtgcgcttgcgtgcctggcagtcggcaacccatgcgctgcgatccttcagcttgccggcggccttccattcctgcgcgaccgcgacgaacagttccagcgcggccctggcgtccgacacgatgccgagatccgggccgaacacgcggccgatctgcgtcggctcgatgtcgacgtgcacgaacttgcggcccttcgtatagacctcgacgctgcccgtgtgacggttcgcccagcggttgccgatgccgagcacgaagtccgatgcgagcagcgtcgcgttgccgtagcggtgcgacgtctgcaggccgaccatgccggccatcagcgggtggtcgtccggaatcgcgccccacgacatcagcgtcgggatcaccggcacgccgatcgtttcggcgaactggacgagcaggtcttccgccgccgcgttgagcacgccgccgcccgacacgatcagcggcttgtccgcgtcgttgagcattgcgagcgccttctcgatctgcgcgcgggtggccgcgggcttgtagaccggcagcggttcataggtgtcgatgtcgaactcgatttcggcgagctgcacgtcgatcggcaggtcgaccagcaccgggcccgggcggcccgagcgcatcaggtggaacgcctgctggaacacgcgcggcaccagcgccggttcgcgcacggtgacggcccacttggtgacgggctttgcgatcgattcgatgtcgacggcctggaagtcttccttgtacaggcgggcacgcggtgcctggcccgtgatcgcgaggatcgggatcgagtcggcggatgcggagtagagaccggtgatcatgtcggtgccggccgggcccgacgtgccgatacacacgccgatgttgcccggggccgcacgcgtgaagccttcggccatgtgcgacgcgccttcgacgtggcgggccagcacgtggctgatgccgccggacttgcgcatcgccgagtagaacggattgatcgccgcacccggcacaccgaacgcggtctggatgccttccttctcgagcacgagcacagctgcgtcgacggctctcatcttggccatgaatgtctccttgaatggggtagatcttgcgaatgggtctgttggggacactttagggatgcaggaaaggtttgataagatccggcgaagtcgctttttcgaaactaaaagtatggaatgacggccgggcggggctttccgccggagccggaacagagacggagacgggagatggatcgcttcaagcagatcgagacgttcgtgcgcgtggccgatgccggcagcctcgcggcggcggcgctcgaggagggcgtgtcgccggtcgtgctcgggcggcgcatcgacgcgctcgagaagcggctcggcgtgaagctgatgtaccgctcgacgcggcggctggtggtcagcgaggagggcgcggcgttcctcgagcgctgccgcgggctgctgtccgaatgggaccaggccgagaacgaactggccgccgggcggcgcgcggtcagcgggcacctgatcgtgtcggcgccggccgcattcgggcgcaagcacgtcgcgccgcacgcgccgggctttctggccgacaagccggagatgcagctgtcgttcaacctgaccgaccgcgtcgtcgatctcgtgcgtgaaggctacgacctgtcgatccggatcggcggtgccgtcgatccgaacttcgtcgcggtgaagctcgcgtcgaaccggcgcgtcgtgtgcggcacgcccgagtatttccgccggcacggccggccgaagtcgctcgacgacctgctcaggcacaactgcctggcgttcaacctgcagggcgggcagaaccgcggctggtatttccagcgccacggcaagatcgcgacgatgcgcgtggccggcaacctcgactgcaacgacggcgagctgctgcaccgctgggtggccgagggctcgggctcggctggcgctcgacgtgggaaatcgccgcgcagctcgagacgggcgagctcgagaccgtgctcgacgaatacgcgctgcccgactacgacatcctcgcggtctatccgcagcagcgctacgtgccggcgcgcgtgcgctatttcatcgactacctgcgcgccgcgtatgcgcgccccggttactggagcaccacgccgtaacggcaggcgggcggcccggcgtttttacgcttcatgcgtccggcgcgggaataaactcgacgcagcaacggtatggtcatcgagcgcgcacgttgccggtctgtccgggcgccgtgcgcggaacgggcgcggcatcggccgccgggaccagggaggccatgtggggcaagccggacaggcggtcgaagaacgggtggcagacgacgcagtcgcgcgcggcgagcggtttcgcgcgctcgtgctgccgcatctcgacgccgcgtacaacctcgcacgctggctgagcggtaacgccggcgatgcggacgacgtcgtccaggacgcgtgcatgcgtgcgttgcgcttcgtcgattcgtgtcgcggcgacaacgcgcggccgtggctgctgacgatcgtgcggcacacctggtacacggagtggcggcgccgcacgcatgcgcacgaggtcgcgctgcccgacacgctggacgacaccgacgtgcccgacgactggcagcccgccaccgaggacccgctcgcacacctgctgcgcggcgagaacgtgcggctcgtgaacgcggcgctcgcgaagctgccgcccgaataccgcgaggtgctggtgctgcgcgagatggaggacctgagctaccgcgagatcgcggcgatcgcggatgtgccggtcggcacggtgatgtcgcggctcgcacgcggccggcgcaagctcgccgcgctgctgggcggcccgccggcaccggcggccgaaggcaggccgggccgtacgccggcaggcggaaccgcatcggaggctatcgatggactgtaacgaagcgcgagcattgctggacgcggacgtcgaccgcgagctgtcggcgcccgacgcgttgcgggtccagcagcatgtcgaagggtgcgacgtgtgtcgccaggaacgcgaacggatcgtcacgctggtgcaggccgtgcgtcaggccgactatcatcgtgcgccggatgcgttgcgggcgagcattcttgcgagcctgcctgccgcggccgacgcgcctgcccgcgagcaggcgcgggcggagccgcaatccggatcccgatcgcagccgcagcggcggccgcgcgggcgtaacgggttgtcctggttgccggggcttggcggggcggcacgcccggccacggccggcaccgggccgcgcttcgcggtattgcccggcctcggctggggcgtcgcgctgctggtggcgcttgccgcggccggcgggatggtggtgtccgcgcgtcacgccgacaccgaccgcacgatcgacgaactcgtgtcgagccacgtgcgtgccgacctgtcggcacgcgacatcgacgtgatctcgaccgaccggcacacggtcaagccgtggttcaacggccggctcgactatgcgccgccggtcgaggatctcgcggcgaacggcttcgcgctggtcggcggccggctcgactacgtcggacgccgccgtgtcgcggtgctggtctaccgttaccggcagcacgtgatcgacgtctatgtgcggccggccggggaagggccggggcgccgtactcgaccgtgtcgcagggttatgcgctcgaccgctgggatgcggccgggatgacgtggtgggccgtgaccgacgccgagccgtcggcacttgcggcgttcaggaccgcgctcgacgcgcggctggccggcacgcgcagcgaatgacgccacgacggcgggctgcgggcccgccgcacgcttgcgttccgaccctgaccgggaaaaggccgaagaacggtccggctgtccggtctcgccccttcaagtctttgaaaacatggccgaatccgcgcgccaatcgtcgattggtcttgcatgtgccccgtatccgggttagaatcttcggcttctcacttgccacaccggttcagacgcccgggtggctttaatccacaaggagtgtgtaatgcgtcattacgaaatcgtattcatcgtgcaccccgatcagagcgagcaagtgcccgcgatgatcgagcgttacaagaccacgatcacgtcgcacggcggccagatccaccgtgtcgaagactggggccgtcgccaactggcctacatgatcgagaaactcgcgaaggctcactacgtctgcatgaacatcgagtgcgaccagacgacgctcgacgaactcgaacacgcgttcaagttcaacgacgccgtgctgcgccacctcatcgtcaagatgaagaaggccgaaaccggcccgtcgccgatgatgaaggaagttcagcgcgaagaagccaagaaggcggctgcagctcagccgaccgaagcgcaggcttaagttcgtcattcattaagccatcaaggagcgcgccactcacgtgaacaggttgcaattgacggcgagcgtcgtcgaacgcgcaccggtgcgatatacgccggcaggtgttccgatcgcaagcgccacattgcatcaccgcacggaagtcgtcgaagcaggcattccccgtcaggtcgaaatgacgatcgaggcggtggcggccggtgaggcgagcggcaggctggaaagccgtgaaatgggcgtcgaaacgctgttcacgggcttcctggcaaagaaaagccgcaacgcgagaaccttggtgtttcacatcacagcattgcaggacattggaaaggactgaaatcatgccccgcccgactggtaagaaattcgacaagcgtcgtcagcaacaaaacccgctcttcaagcgcaagaagttctgccgtttcacggccgcaggcgtcgagcagatcgactacaaggacacggaaacgctgaaggacttcatcggcgaaaacggcaagatcacgccggcgcgtctgacgggtacgaaggcgcactatcagcgtcagctcgacacggcaatcaagcgtgcgcgtttcctcgcgctgctgccgtacaccgatcagcacaaggcgtaactcggcgacgccataaggagaattcgaatgcaaatcattctgttggaaaaagtcgccaatctgggcaacctcggcgacatcgtcaaggtcaaggacggttacgctcgcaacttcctgatcccgaaccgcaaggctcgccgtgcaacgaaggaagcgatcgccgaattcgaagtgcgccgcgctgaactcgaaaagatcgccgctgaaaagctggcagcatcgcaggcagtcggcgagaagctgaacggccagtcgttcgaaatcacgcagaagtcgggcgttgacggccgtctgttcggctcggtcacgaacggcgacgtcgcggaactgctgaagaaggcaggtttcgaagtcgagaagctgcaagttcgcatgccggaaggcccgctgaagatgatcggcgagcacaacgtccaggtcgcgctgcacacggacgtcgtcgtcgacgtcacgatcaacgtgatcggcgaccacgcgtaagcgtatgcaagctttccgggcggcttccgtcgtccggacaagggcaggcgcccgggcaaccggggcctgcctttttatgcccgatcgccggagcggtagcgctgccgtgatctattcgcgataatcccaacccatgaacgcgccgcaagatccccaaatcgaatcgctgaaagtcccgccgcattcggtcgaagccgaacagtcggtgctcggcggcctgttgctcgacaacgcggcatgggaccggattgccgacttcctgtcgcagggcgatttctatcgctacgatcaccggatcatctacgagcacatcggccggctgatcgcgtcgacgcgcccggccgacgtcgtgaccgtgtacgaagcgctgaccacgtccggcaaggccgatgacgtcggcggcctcgcgtacctgaacgccctcgcgcagaacacgccgagcgccgcgaacatccgccgttatgcggaaatcgtgcgcgaccgtgcggtgctgcgccggctcgtgtcggttgccgacgaaatctcggccgatgcgttcaacccgcagggcaaggaagtccgccagctgctcgacgaggccgagtcgaaggtgttctcgatcgccgaagagggcgcgcgcggcaaccagggcttcctcgagatcggcccgctgctcacgcaggtcgtcgagcgcatcgatacgctgtaccacaccgcgaacccgagcgacgttacgggcacgccgacgggcttcgtcgacctcgaccggatgacctccgggatgcacggcggcgaactgatcatcgtcgcggggcgaccgtcgatgggtaagactgccttttcgatgaatatcggtgaatacgtcgcggtcgagtacggcctgccggtcgcggtgttctcgatggaaatgccgggcacccagctcgtgatgcgtatgctcggctcgatcggccgactcgaccagcaccggatgcgtaccggccgcctgacggacgaggattggccgaagctgacgcacgcggtgcagaagatgagcgaggcgcagctcttcatcgacgagacgggcggcctgaacccgatggaattgcgctcgcgcgcacggcgtctggcgcggcagtgcggcaagctcggcctgatcatcgtcgactacctgcagctgatgtcgggttcgtcgcagggcgagaaccgcgcgaccgaaatctcggaaatctcgcgatcgctgaagagtctcgcgaaggaactcgacgtgccggtgatcgcgctgtcgcagttgaaccgcggcctcgaacagcgcccgaacaagcgtccggtgatgtccgatttgcgcgaatcgggcgcaatcgagcaggatgcggacgtgatcctgttcatttaccgtgacgaagtttacaacccggacagccccgacaaaggcacggccgaaatcatcatcggcaagcaacgtaacggcccgatcggccccgttcgactcacgttcctggggcaatacacgaagttcgacaattttgcgggagcgcagactttctacggcgagtagcgccggttgtaaagccctaaatcgccaaacgttgtatccaatcccggcgtgcgcatgtgcgcgcgtcgcggcgcgaccgaaaacggtacaatgtcgcccgttttcgtgacagtagtttgacaatctctcaggaatcccatgttcggtcgattcatgcccaccgagggcaagttctttgaactcttcaacgcgcacgcgaagcacatcgtttccggtggccgcgagctcgaactgctgatcgacaatctcgccgacgccgagattcacaagcaaaacgtgcaaattgccgagaaggccgctgacaagctcacgcacgaggcgatcgatctgctgcacaagactttcatcacgccgctcgatcgcgacgagatccacaagctgatcacgacgatggacgacatcctcgacctgatggaagacgtcgcgaccgccgtgtcgctgtacgacgtgcaatccgtcacgtccgaggcgagccagctcgcgcacatcgtcacgcagtccgcccagcacgtgcagcaggcggtcgggttgctgtccgacatgaagcagtccgcgcagatcctcaagcagtgcgaggagatcgaccgctgggaatcggaggccgatcgcgtgctgcgcgcggcgatgtcgaagctgttccgcgaggaagacgacgtgaagacgctcatcaagctgaaggcgatctacgagctgctcgaagagatcaccgacaagtgcgaggacgtcgcgaacatcatcgaaggcatcgtgctggaaaacgcctgagcggaccacgatgcattcgatacaactcgccctctggatggtcgcgacgctggtgctcgtcgcgctcgtattcgacttcatgaacggctttcacgacgcggcgaactcgatcgccaccgtcgtgtccaccgggtgctgaagccccagcaagccgtggtgttcgcggcggcgttcaacgtcatcgcgtatttcatcttccacctgaaagtcgcgcagaccgtcggtaaaggcaccatcgatcccgagatcgtcgaccactacgtcatattcggcgcgctggtcggtgcgatcggctggaacgtgatcacctggtactacgggattccgtcgagctcgtcgcacgcgctgatcggcggcctcgtcggcgcggcgctcgccaagtcgggctgggcttcgctgaacatcgacgggttgctgaagaccatcgcgttcatcttcatttcgccgctgctcggcttcattctcggttcgctgttcatgctcggcgtgtcgtggctgtatttccgaaccgcgcccagcaaggtcgaccggcgtttccgccggctgcagctgctgtcggccgggctgtacagcctcggtcacggcggcaacgacgcgcagaagacgatcggcatcatctggatgctgctgatcgcatcgggctatgcgtcggcgaccgccgatgcgccgcccgcgtgggtgatcggcgcgtgctacctgtcgatgggcctcggcacgctgttcggcggctggcgcatcgtgcgcacgatgggccagaagatcacgaagctcaagccggtcggtggtttctgcgcggaaaccggtggcgcgatgacgctgttcctcgcatcgttcctcggcattccggtgtcgaccacgcacacgatcaccggcgcgatcgtcggcgtcggcgcgacgcagaagctgtcggccgtgcgctggggtgtggccggcaacatcgtgtgggcgtgggtgctcacgctgccggcggccgcgctgttcgcggccggtggatggtggctcggccaccagatcttctgatcgaccgcactgtcgaacggacctgaaatgcgccgcaagccgaaggctgcggcgcattttcctttggggcagcggaaatatgcggcgaatggcgggtttgtagtcgcgcgtgatcgcaggcgaacgcgaagcgggctagtaacttccgttcgcgaaccgggcaatcggatcgtctgcggtggcggtgcgcgggctgacgggggcagattgcgtcgacgcgcgcaatacctgcacgggggctggttcggtgccgcgcggtgacgtcgccgcgacggcgggtggcggctcagcatcgaaggcggcagcctgggcggccgtcagtgccgtcgtcggaatctgggtgccgacctcggccggaccggctggcgctgcattcgcggccaaggtggcggcggctgtgctcgtgccgtcgttcacggaagttgcctgctgctgagccgtctgcatgcgcggcggcggaggttcatacgggtcggccgacgcggctgcgggcgcgaccgcggcggtcgacacggcctgcgcggccggcacgaccggggcaggcgcccgggtcgcggcggcttgcgactgcgtataggccggctgccgcggcgcggcggcggtcacgacgacaggggcgggcgcaacgaccggcgcgctgcgcggctcgtcgcgcttcgcctcgtaggtcggcgcatcgaacggcgtaggtgccccgcgcggcggcgcgacgcggcgaatgccgtcgaaacgcttggcccagtacgggttcgtcaggtagtcgagccgcacggtgccgcccgtcgacggtgcgttgacgaagcgtagcttgccgacgtagatgccgacgtgcgaatgcggccgtccggtcgtgttgaagaagatcagatcgcccggcgcgatctggtcgggctcgaccgatacgccgcggccgctcatgtcggcggtcgtgcgcggcaggttcacgtcggctgcgcggccgatcacgtagcgcacgagcccgctgcagtcgaagccgctcgtcggcgtgttgccgccccagcgatacgggacgccgacgaggctcatcgcctggatcgaaatttcttcctggccgacgctgtgatcgacgaacttcgggaaattggcgggggcggggaatgcgcgcggcgtcgtgatcttcatgcccgacgcggggcgcgatgccgactgcggcggcacgctggagcaggccgcaagcagtgaaacgacagcaacgggaacccagattcgaagcatggcaaggcgggcgagcgcgggacgctcgcgaatcgtatgacaacagacagacccgatggtagacgttccggcggggcttaagcaaccgttcctgagaatttacttgaagtttcgcgcgtaagtgcggctgttgcgtaacgatgcatgaccaacgtttcagaccccaaaaataaaaacggcgctccggaaacggagcgccgcgatgcgtcgacagccggccgacgggccggcctgtcgcgttacaggatgtccgacgcgtagtcggcgagtcgcgagcgttcgccgcgcgcgagcgtcacgtggccgctgtggccccagcccttgaagcggtcgacgacgtacgtgagccccgagctgccttcggtcaggtaaggcgtgtcgatctgcgcgatgttgccgaggcacacgatcttcgtgcccgggcccgcgcgggtgacgagcgtcttcatctgcttcggcgtcaggttctgcgcctcgtcgatgatcaggtacttgtcgacgaacgtgcggccgcgcatgaagttcatgctcttcaccttcaggcgcgaacggatcagttcctgcgtcgcggcacgcccccattcgccggcggcgtcgtcggtcttctgcagcacttcgaggttgtcgtcgaatgcgcccatccacggctgcatcttctcttcctcggtaccgggcaggaagccgatgtcctcgccgacgggcacggtcgcgcgcgtcacgatgatctcgttgtagcgcttgtcgtcgagcacctgcgcgaggccggccgcgagcgcgacgagcgtcttgccggtaccggcctggccgagcagcgtgacgaagtcgatctccgggttcatcagcaggttcagcgcgaaattctgctcgcggttgcgcgcggtgatgccccacacgttgttcttgtggtggctgtagtcgcgcagcgtctgcagcagcgccgtcttgccgttcagttcacggacgatcgcatggaacgtcggctcgccgttctgcggctcgagatagacgaactcgttgacgagcatcgacgagacgagcgggcccgtcacgcggtagtacgtggtgcccgtcttcgtgtcctgccagctctccatgcccttcgcatgcttggtccagaaatcctgcggcagctcgcgcacgccgttgtacaggagatccgaatcctcgagcacctggtcgttgaagtagtcttcagcgggcaggccgagcgcatgcgccttgatccgcatgttgatgtctttcgacaccagcacgacctggcggtccggccggtcgcgttgcagcgcgcgcacgacgccgaggatctggttgtcggccttgccttcgggcaagccttcgacgggcgcgatgtcggtgagcttcgtctggaagtacaggcggccgaccgcctcgcggctgccgaggcgcgacagcggaatgccggccgtgatcgggcccgcgtcggcgaccagcgcgtcgagcgtgcggctgacctggcgtgcgttgcgcgcgacttcggacatccccttcttgtggttgtcgagttcctcgagcgtcatcatcggcagatagacgtcgtgttcctcgaagcggaagaggctgctcgggtcgtgcatcagcacgttggtgtcgagcacgaacagtttctgctgttcggcttcggcggccttgcggctgcgcgatttcgtcgcggcgcccgtgtcgcgcgcgggagccgcggccggtttgccggcggccggcttgtcgttgcgcgcgacgaccggcgccgcgggttcggcgggtgccggcatcggctgcaacagtgcggccgtctgtttggtcttgcgaccgcgcgcgggtgcgctcgcggtttcctgcgccgaagacgcgacggcgcgcagcggcgcggccgtgttcgcggcttcgatcatcggttgggccacgctcgccggaccgtagtcaccggctgtggatgcgtccccttcggcggatttcttcgcggctttcgcgggccgcgctttcaccttgtattcgtcgggcggcagcaggctgccgagcttgctggggagtaggcaaaggcatggtgtccctcgggaggaatcgtgtcgcatggcgtgcgccgctgatcgcatcctgcgtgacgtagacgcatgcagtttgcgcgcggtggcgcacaggaagttcgtctagccggttcgcctaagtgtcgatcagctccttgacggggtgagggccggaccgagggccggcgcgcaatccataaaaagccgctgccccgtcgacagggacatgcggctcggctgatacggtcgtgatgcgcgtcaagtgccggaaagcatcgcatcgagcaccggcgcagctacgagaaatatggggcgaactggcattcattgcggcccaatataacgcgcctcaaagcgcttgtacagcacttagcacgtcgtccacatggcccggtaccttgatgccgcgccatgcctggcgaagcacgccgtcggcgtcgatcaggaacgtcgagcgctcgattccgcgcacttccttgccatacattttcttcatcttgatgacatcgaacagcgcgcacagcgcttcgtcggcatcggaaatcagcgggaacggcagttcgagctttgccttgaagttgtcatgcgagcgcaggctgtcgcgcgacacgccgatgacttccgcaccggctttcttgaacgtcggatagagatcgcggaactgcagcccttcggtcgtgcagcccggcgtgttgtccttcggatagaagtacagcacgagtttcttgcccttcaggtcggacagcgaaatgtcgccgcccgtggccggtgcggtgaaatcgggaacttgacggtcaacttcgacggacacgtgtttctcctgttgttatggaaaggcgccgctgcggcggcgcggttcggcggggcgtcgcggcagcgcgccgcatgggcggcgcgggcgacgccggcgcgcgcgaactcagtcgggctggacgatcagttcgccggagcggccgggaatttcgccccacgtgacagggtacgatggcagcgagtcgcggtccagcgtcgcgtggtagtcgcccatcgtcgcaaacgtgtggccttgcgcgcgccagccggcgagcagttgctcgaacacgggcgcgagcttctggccttccagttccgcatgcagcgtgaacacctggtcgtgcggattggtttcggtgaacttgaggatgtgcgcggcgacgttgtgcgtgtcgacgccgtcgatgccgagcacttcgtcgagcgtcggcagcgtggtcggcatctgcacgtgcgacagcgtgcggccgtcgacgacggggaggtacggcgaatggccgcggccgtcggatgcgtagcgcatccccatgcgtcgatctgctcgaacgcggaatcgttcatctgccagccggccgcgccgtgcgtgacgggcggcgcgccgaagatctcgatgaagcgcgcgtgactcttctgcatttcacgcgcggtccagtcgcgatcgcgcgcacggacgttgtcctgccagtacacgtgatcccacgtgtggatcccgcattcgaagccggcctcgtgaatcgcgcgcatgtcggcgatcgcgcggcggccgatgtcggggcccggcagcagcacgccgtacatcagctgcttcacgccgtagtgttcgaccaccgatgtgcgcgacaccttcttcaggaagccggggcggaacacgcgccgcagcgcccagcccgtgtgatcgggcccgaggctgaagaggaaggtcgcgcgcgcactgaagcggtcgaagatgcgcgcgaggttcggcacgccttcgcgcgtgccgcgcagcgtgtcgacgtcgatcttgaggacgatgcgagccaagcgaacgtcccgctcagccttgctgctcgacgagcgcgcgcgcgtcggcgacgtggccgcgatacgcttcgaagatgttgcgcagcgcgtcgtcgaacgtcgcctgcggtgcccagccgagctcctgcatcgtgttgtcgatcttcggcacgcggttctgcacgtcctggtagccgttgccgtagtacgcgccggacgtcgtctcgacgagcttcacctgcttggccgaatcggcgtattcggggaattccgccgccagttcgagcatcttgtgcgcgagttcgcgaaccgagaagttgttcttcggattcccgatgttgtagatcttgcccgacgcgacgccgtccttgttctcgatgatcttcatcagcgcgctgatgccgtcgccgatgtcggtgaacgcgcgcttctgcgagccgccgtcgacgaggctgatgttctcgccgcgcacgatgtggccgaggaactgcgtgacgacgcgcgagctgccttccttcggcgtgtagatcgagtcgaggcccgggccgatccagttgaacgggcggaacagcgtgaagttcaggccttccatcccgtagccccagatcacgcggtccatcagctgcttcgagcacgcgtagatccagcgcggcttgttgatcgggccgtaggtgagggccgatgcatccgggtcgaactgctcgtccgagcacatgccgtagacctcggaggtcgacgggaacacgaggtgcttgccgtacttgacggccgaacgcacgatcggcaggttcgcctcgaagtcgagttcgaacacgcgcagcggctgctggacataggtggcgggcgtcgcgatcgcgacgagcggcaggatcacgtcgcacttcttcacgtgatactcgacccactccttgttgatcgtgatgtcgccttcgaagaaatgcatccgctcgtggttgacgaggtcgccaagccgatcggtctgcatgtccatgccgaacacttcccaatcggtggtttcaagaatgcgcttcgacaggtgatggccgatgaagccgttcacacccaggatcaggactttttgctttcatgaatgacgggaagaatgaatgaactgcgcgaattccgcgggcgtcacgacggtttcgctgccgtcgcgctgctgccacagctcgagaatgaatagagcgcggctgtcgccgcagacgccgaatagcgcattatcgcttacgtgcaggccgggcggcaaatctgccgcggcggccgctgccgcgctgccgggcgccgcgaggcgcgcgcgcgcgatcacgaaacgcgtgccgtcgacgtccgtgaacgcgcccggatacggggcgcgaccgcgcgcaccaggttgtagacctgcgcggccggcttcgtccagtcgacgcggccgtcttcgggcttgcgcccgccgtagtagctgccggtcgcgagatcgttcggcaggtgcggcgcctcgcccgcgaggagcgcgggcagtacgcgccagagcgtctgctcggcggccaccgtgaccttgtcgaacacctgcgcggccgtgtcgtccggcaggatcggcaccgcggtctgggcgatgatcgcgcccgcgtcgggcttcgcggccatctcgtgcagcgtcgcgccggtttcggtctcgccgttcagcacggcccagttggtcggtacccgaccccggtatttcggcagcagcgaaccgtgcatgttgtacgcgccgcgcggcgcgatcgcgagcaggtccaccggcagcatgtgacggtagtagaacgagaagatgaaatcgggctgcgcgtcggacaccgcgcggcgcagcgccggatcggcgggatcggccggcgtgacgaccgggatcccgtgctcggcggcgaccgatgcgacgctgccgaaccagatgttctcgttcgggttgtcctcgtgcgtgacgacgagtgtgacgtcgacgccgcgcgcgagcagcacctgcaggcagcgcacgccgacgttgtgatacgcgaagacgactgcgcgcggtttcattgcccggctcccgtgcggttcgcgccggcgggcaccggcggcacgccgtcgtgctgctcgagcacggcctggatcaggtagcgcggccgcgcgcgcacctgctggtagatgcggccgacgtactcgccgagcaggccgagcgcgaagatgatcacgccgagcaggaagaacgtgatcgcgaacagcgtgaacacgccttgcacttccgcgccgacgatgaagcgtcgcacgagcagcagcacgaacagcgcggcggagccgagcgacaggatcacgccgatgaacgacagccactgcagcggcacgaccgagaagccggtcacgaggtcgaagttcagccggatcaggctgtacagcgagtacttcgattcgccggcgaagcgctcctcgtgcgcgacctcgatttcggtcggcttctgcgcgaacgtataggcaagcgcggggatgaacgtgttgacttcgccgcacacgttgatcgtatcgatgatgcggcggctatacgcgcgcagcatgcagccctggtcggtcatcttgatgcgcgtgatgcgctcgcgcagccggttcatcatctgcgacgccttgcgccgccacaggctgtcctggcgctgcttgcggatcgagccgacgtagtcgtagccctcgcgcatcttcgcgatcagcttgccgatttcctcgggcgggttctgcaggtcggcgtcgagcgtgatgacgatctcgccgcgcgattgcgcgaagccggcgaggatcgccatgtgctggccgtagttgccgttgagcagcacgatgcgcgtcgtgtcgggacgcacgtggaactgatcggcgagcatcgcggccgagcggtcgcggctgccgtcgttgatcaggatcacttcgtatgacgtgtcgagtgcgtcgagcgccggatacagccgcgcgaacagcgcggcgaggccgtcttcctcgttgtacacggggatgatgaccgatacttcgggacggcctgcgtccaggtgcccggcgcccggatgcccggcgcgtgcttcaaggtgactcatgtacgcttaatttccgtattgttcgcaaatctggttgatggcgtcgaccacacgacgcacatcgccttccgtcatctgcgtgaagagcggcagcgtgacggtcgacgcgccgtaccgttcggcgtggggaacatgccctccttgaagccgcgcgcacggtacagcgtgaaaagatggatcgccgggtagtggatgcccgtgccgatgccgcgttccttcatctgcgccatgaactcggcgcgggtgatcgtcagccgctcgagcggcagcgtgatcaggaacatgtgccagttgccgttctcgaattcggcgaccggcaggccgacaccgagcttcacggccgcgctgccgtcgaatgcggcgaaatacgcgcgggcgagcgcgcggcgctgggcggtgaagcgttcgaggtgcggcaactggcccaggccgacgcgcgcggcgacgtcggtcaggttgtacttgccgccgagcacgtcgcagtccattccgtcgaagcccgtgcgcgtgatgccctgcagccggtacttctgcgcgagcgtcgcttcttcctcgttgttcagcacgagcgcgccgccttcgatcgtcgtgaggttcttgttcgcgtggaagctgaacgacacgatgtcgccgatcgcgccgatgcgcttgccgttccacgtcgaaccgaacgcctgcgcggcgtcctcgatcacgcgcagcttgtgtgcgcgcgcgatcgcgtacaggcggtccatgtcgaccggcaggccggacaggaacaccgggatgatcgccttcgtgcgcggcgtgatcgcctgctcgagcttgtcgaggtcgatgttgcgcgtgacgggatcgatgtcggcgaacacgggcgtcgcgcccgtctcgaggatcacgttgctggtcgagacccacgacgccggcgtcgtgatcacctcgtcgccggggccgacgcccgcgatgcgcaggccgatctcgagcgtgcaggtgcccgagttgaacgcgcggacgggacggccgccgcagtattcagacagcgccgcttcgaatttctggctttgcgggcccgtggtgatccagcccgaacgcagcacttcgacgacgccctggatggtttcctcatcgatctcggggcgggtgaacggcagaaacggagcggtagtctggctcatgtacgctttggcctgtaatggcgtgtaataaagggtcgggcgatcccggccgaaaccggcattaaacaccggttggcggaaacgcaccgtgatttttgtaggcggacgcttaacgcggcggggcgtgctcagcttcgcgcgagcaccagcacgccgatcaggatgatgccgatgccgacgagccgctggatcgacagcacctcgccgaacaggtaccaggccgcgaacgcgttgacgacgtagccgagcgacagcatcgggtacgcgatcgacacgtcgacccgcgacagcccgaggatccagaccacgacgctcagcacgtagcagccgaggccgccgatgatcggcagctgggtggcgatcttcagcccgaccgggatgatgttcgcacggctgaattcgaagtgcccgacggcgttgacgccggccttcagcagcagttgcgcaacggcgttgagcatcacgccggtgacgatgcagacgagcgaaacgggattcatgcgatgggcgtccttacgattgcggtttctcgacgatcacgcgacggttgtcgcgcgcaatcacgcgcatcggcacgccttgcgtgaccagggcgtcgtactggccgggcggcatgatcgcgagcgcatgggtttcctgcttccagcgcgtgatccattcgtcgacggtcggaatccacttgttcggctccatcgagatgccgaacccgagctcgtcctggcgctggaccatgatcgtcgtgtggcccatatagaacgggaacgtgtgatcgagcatctcgatcgagtagaacggcgtgtcgggcggcagtttcgccagctcggcgcgtaccgtcggcgcgagcagcgcgcccgagctgtagcggccgaactcgtcgtgcccggtgccgccgatcgtgccgaaggcgagccacgcggcgccgaacgcggctagcgcggcggcgacgcccgcgcggcggttcagccaggcggccgcgagcgtcagcgcggcagcgaccgcgaggcccgcgtacagccacatctggaacgcgcggtacagcgcgttcggcgtgcgggcatcgccctggtacgcgaggaagatgatcccgaacgccgcggcgacgaagaacacgaggtagccgagcaggtggcggcggaagcggtcggcggtcatcagcggcaggtacgcgccgatgatcagcgcgagcgccggcgcgaccggcagcacgtacgagatcagcttcgaatgcgacgcgctgaagaacaggaagatgaatgcgctccagatcagcagcacgagcatcggcgagaagccgttcggctggcgcggcatccgcagtgcatggcggatgctctgccacgcaaccgacagccacggcaggaagccgaccagcagcacgggcacgaagtagtagagcgggcccggacggttctgttccggggtcaggtaccggcggaactgctggacgatgaagaagaagttgaagaattcggggttgcgctgctggacgagcacgaaccacggcgtgacgatcgcgaagaagatcacgaggccgctcaccaggtacaggcgcttccagagcgcccagtcgcgcgcgatcaacgtatagagcacgagcacggcgccgggcaggatcaggccgacgaggcccttcgacagcaccgcgaacgccatcgcggcccagcacgcccacatccagccgcgcgccgcggccgggcgcagcccgggccgttgcgcgagcagcagcgagcacagcgacagcgccatccagaacgcaaggcccatgtcgagtgcgttgaagtggcccatcaggttccagtacggcgacgccgcgagcacgacggcggcgaggaagcccgacagcgggttgaacaggcgcgcgcccgtgaagccgaccagcagcacgccggcgaagctcgcgagggccgtgtagaggcgcgcctgccattcgccgatgccgaaccacgcgaacgtgagcgcgttcatccaggtctgcagcggcggcttctcgaagtacttgtagccgttgtagcgcggcgtgatccagtcgccggtgacgaacatctcgcgcgccatttccgcgtagcggccttcgtcgctcgggatcaggtggcgcagcccgagcggcgcgaaccagacgatcgcgagcgcgacgacgaggaggacgagcgtgatgcggttgagcggtagcctcgacggcgtatcgttcatggattttcagcctgttggttgttgtgacgggccgccggcgggttgcgccggggcgggcggcctggccgggccgatccggggatcgacccgctgcgccggcccgagttttaccgcatcggggattaacgttcaattaagagcgcggcggcgactttacggccttcggccatcaggatgttgtaggtgcggcaggccgcctggaaatccatcgtctcgacgccgatccgcttggccgtgagcgccgcgacgagccgcgggtgcgggaagcgcaaccgtgcgccgctgccgaagatgacgagttcgggcgtcgggtcgagcagcatcgcgaaatgctcgggcgcgagcgcgtcgaacgacgacaccggccacatctggaccggcgcgccgggcagcacgatgacgctcgtttcatggcgttcgagattgacgtcgacataatcggggccgtagccggtgacggtgttgagcgcgccgctcgtgtcctggtgcagtttcaaatcggtattccgcggttccgtagggaatgtgtcgcagggccacagggcccggagggccggtttcgcttgcccgggcacgcgggacgcctgacggcgtgggcccggcgcggctatggtgcattgcgaaagtcggccaaaatccgctaaattataacttttggtcgccccgggcgccacttgcgtcgcgcgtcgccacaagccgcgcccgaccgcccgcttttccccagtctagacagcgcgcacagaccggccgctttccagttttgatcccgtccccggccgcaaggccaacccaggaaccgtgtcgtcgtgaaaccgattcagaagtcgaacaagctgctcaacgtctgctacgacatccgtggcccggtgctcgagcacgcgaagcgcctcgaggaagaaggccaccgcatcatcaagctgaacatcggcaacctcgcgccgttcggtttcgatgcgccggacgagatcatccaggacatgatccgcaacctgccgacgtcgtccggctattcggattcgaagggcgtgttctcggcgcgcaaggccgtgatgcactacacgcaggaaaagggcgtcgtgggcgtcggcctcgacgacatctacatcggcaacggcgcgtccgagctgatcgtgatggcgacccaggcgctcctgaacgacggcgacgaagtgctgctgcccgcgcccgactacccgctgtggacggcggcggtcagcctgtcgggcggcacgccggtgcattacatctgcgacgagcagaacgcgtggatgcccgatctcgacgacatccgccgcaagatcacgccgaacacgaaggcgatcgtcgtgatcaacccgaacaacccgacgggcgcgctttattcggacgaattgctgctcgaactgctcgagatcgcgcgccagcacgggctgatcgtgttcgccgacgaggtgtacgacaagatcgtctacgacggcctcgagcatacggcgctggggtcgctgtcggaggacgtgatcaccgtcacgttcaacagcctgtcgaagagctatcgctcgtgcggctaccgcgcgggctggatggccgtgtcgggcctcggcggcgacaaccgccggcgcgcgagggattacctcgaggggctcggcatcctgtcgtcgatgcgcctgtgcgcgaacgtgcccgggcagttcgcgatccagacggcgctcggcggctaccagagcatcaacgagctgatcatgccgagcgggcgcctgtacaagcagcgcgaactcgcgtatgacatgctcacgtcgatcccgggcgtgacctgcgtgaagccgcaggccgcgctgtacatgttcccgcgcctcgacccgaagctttatccgatccagaacgaccagcagttcattctcgacctgttgctcgaggagcgcgtactgctcgtgcagggcacgggcttcaactggacgacgccggaccacttccgcgtggtcttcctgccgaacctcgacgacctgaccgattcgatcaaccggatcgcacgcttcctcgacggctaccgcaagcgccattcggcctgagcggcaggaccacacggcactcactacttcttactcatcgatcacacgcagcatggaaccgatcaaagttggcctgttgggcttcggcacggtgggcagcggcaccttcacggtgctgggccgcaaccaggaagaaatcaagcgacgcgcggggcgcggcatcgaggtgacgcgcattgcggtgcgcaacccggccaaggcgctggctgcgctcggcggcgatgccggcgctgcgcagatcaccgacgatttcaacgcggtcgtcgatgatccgtcgatcgcaatcgtcgccgagatgatcggcggcacgggcatcgcgcgcgacctcgtgctgcgcgcgatcgcgaacggcaagcatgtcgtgacggccaacaaggcgctgctcgcggtgcacggcaccgagatcttcgaggccgcgcgcgcgaagggcgtgatggtcgcgttcgaggcggccgtcgccggcggcatcccgatcatcaaggcgctgcgcgaaggcctgaccgcgaaccgcatccagtacatcgcgggcatcatcaacggcacgaccaactacatcctgtcggaaatgcgcgatcgcgggctcgacttcgcgaccgcgctgaaggccgcgcaggagctcggctacgcggaagccgatccgaccttcgacatcgaaggcgtcgacgccgcgcacaaggcgaccatcatgagcgcgatcgcgttcggcgtgccggtgcagttcgaccgcgcatacgtcgagggcatcagcaagctcgacgcgaccgacatccgctacgcggaagaactcggctaccggatcaagctgctcggcatcgcgcgccgcgccgcaaacggcatcgagttgcgcgtgcacccgacgctgatcccggaaaagcgcctgctcgcgaacgtcgagggcgcgatgaacgcggtcgtcgtgcatggcgatgcagtcggcacgacgctgtattacggcaagggcgcgggcgcggagccgaccgcgtcggccgtggtcgcggatctcgtcgacgtcacgcgcctgcacacggcggaccccgagcatcgcgtgccgcatctcgcgttccagccggacagcctgtcgaacacgccgatcctgccgatcgaggaagtgacgagcggctactacctgcgcctgcgcgtcgccgaccagacgggcgtgctggccgacatcacgcgcatcctcgccgcatcgggcatctcgatcgacgcgctgctgcagaaggaatcggagcagatcgacggcgcgaacggcgagaccgacatcatcctgatcacgcacgagacggtcgagaagaacgtcaacgcggcgatcgcgcagatcgagagcctctcgacggtggtctcgaaggtaacgaagctgcgcatggaagcgctgaactgaggacggaaggcgacatgaactacatctccacgcgcggcgccggcatcggcgagcgccacacgttctccgacatcctgctcggcggcctcgcgaaggacggcgggctgtacctgccgtccgaatatccgaaggtgtcggccgacgagctcgcgcgctggcgcacgctgtcgtatgcggatctcgcgttcgagatcctgtcgaagttctgcgacgacgtgccggccgacgacctgcgcgcgatcacgcgccgcacgtacacggccgacgtgtaccgcaacacgcgccatggcgagaacgcgtccgacatcacgccgctgaagacgctcggcaccgagaacggcgcggcgctgtcgctgctggaactgtcgaacggcccgacgctcgcgttcaaggacatggcgatgcagctgctcggcagcctgttcgagtacacgctcgcgaagcacgggcagacgctgaacattctcggcgcgacgtccggcgacacgggcagcgcggccgaatacgcgatgcgcggcaaggccggcgtgcgcgtgttcatgctgtcgccgcacaagaagatgagcgcgttccagacggcccagatgttcagcctgcaggatccgaacatcttcaacctcgcggtcgaaggcgtgttcgacgactgccaggacatcgtgaaggcggtgtcgaacgatcatgcgttcaaggcgcagcagaagatcggcacggtcaactcgatcaactgggcgcgcgtcgtcgcgcaggtcgtgtactacttcaagggctacttcgcggcaacgcagtccaacgacgagcgcgtgtcgttcacggtgccgtcgggcaacttcggcaacgtctgcgcgggccacatcgcgcggatgatgggcctgccgatcgcgaagctcgtggtcgcgaccaacgagaacgacgtgctcgacgagttcttccgcacgggcgcgtatcgcgtgcgcagcgccgagaacacctatcacacgagcagcccgagcatggacatctcgaaggcatcgaacttcgagcgcttcgtgttcgacctgctcggccgcgatccggcgcgcgtgatgcagctgttccgcgacgtcgaggagaaaggcggcttcgatctcgcggcgagcggcgatttcgcacgggtcgccgagttcggtttcgtgtcgggccgcagcagccacacggaccgcatcgcgacgatccgcgacgtgttctcgcgttacgacacgatgatcgatacgcacacggccgacggcgtgaaggtcgcgcgcgagcatctcgacgcgggcgtgccgatggtcgtgctcgagaccgcccagccgatcaagttcggcgagacgattcgcgaggcactcgatcgcgaagccgagcgtccggccgcattcgacgggctcgaggcgctgccgcagcgtttcgaggtcgtgaaggccgacgcgcagcaggtgaaggacttcatcgccgcccatacgggcgcatgacgcatggccgggccgagagcccggctgtgcaggacggccggaatgccgattcgtcgaacggatcggggttccggccgtttcgtttggcggtgccgcgccgcgcaggcgttcggcatccgccgcgcggctgccgtcaaaccggcatcgcgcgtgaaacaagtgccagacccgcgcgctcgcgcgaatcacagtttccgcatgtctgccatatcgcgcgtccgcgcgacggcgtcgctacaatggcgtattgcatccaacgatccccgattccatcgatgtcgaaccccaatcccgcggcgccgcgcgcgccgatgctgtcgaccgccgaggcgctcgccgcgctgctcgacgccgcgaagccgttgcccggcgtcgaaaccgtcgccacgctcgatgcgctcggccgcgtgctggcggctgacgtgagctcgccgctcgacgtgccgccgatgcatacgagcgcgatggacggctatgcggtgcgcgtcgccgacctgctgcatggcgagcggcgtttgccggtgtcgcagcgcattccggccggccatccggccgcgccgctcgcagccggcacggccgcgcggatcttcaccggcgcgacggtgccgcccggcgccgacgctgtcgtgatgcaggagcaggcgtcggccgacggcgacgcggtcgagatcctgcacacgccgaaggccggcgaatggatcaccgcgcagggcgcggatatccggcagggctcggtgatcctgccggccggcacgcggctcacgccgcaggcgctcggtcttgccgcatcggtcggctgcgcgcagttgccggtcgcgcggcggattcgcgtcgcggtgttcttcaccggcgacgaactgacgatgccgggcgagccgctgaagcccggcgcgatctacaactcgaaccgcttcacgctgcgcgggctgctggagcggctcggctgccacgtgaccgactacgggatcgtgcccgattcgctcgccgcgacgcgcgacacgctgcgcgcggccgcgcgcgatcacgacgtgatcctgacgagcggcggcgtgtcggtcggcgacgaggatcacgtgaagccggctgtcgaggccgaagggcggctcgcgctgtggcagatcgcgatgaagcccggcaagccgcttgcctacggcgcggtgcgccgtggcgacgatcgccccgatgcgcacttcatcgggctgcccggcaacccggtatcgagtttcgtcacgttcctgctgttcgtgcggccgttcctgctgcgcctgtccggcgtgcgcgacgtcgcgccgcgcgcgctgtcgctgcgcgccgacttctcgcaaggcaagggcgaccgccgcaacgaattcctgcgtgcccgcgtgaacgcggccggcggcctcgacctgttcccgaaccagagttcggcggtgctgacgtcgacggtgtggggcgacggcctgatcgacaatccgccgcagcacgcgatcagcgccggcgagaccgtacgtttcattccgttttccgaactgctgtcgtaacgcgacggcttcccgaaccatgaagattcagctgaaatttttgcaagcgtacgcgaggcactgggtgttgccgacgagcaggccgacgtgccggacagcgtcacgaccgtgggcgacgtgcgcgcatggctgcgcgtgcgcggcggggcatgggccgagacgctcgcggaagggcgcgcgctgcgcatggcgtgcaatcacgagatgaccgatcccgatacgcggctcaccgaaggctgcgaagtggcgttctttccgccggtgacgggcggttgaggcaccggcaatggcaacggtacgaatccagaccgacgacttcgacctgaacgccgaggtcgcggcattgcgtgcgcgcaacccgaagatcggcgcggtcgcgtgcttcgtcggcacggtgcgcgatctgaacgaaggtgatgcggttgccgcgatggaactcgagcactatccggggatgaccgagaaggcactcgagaagattgccgccgaggccggccggcgctggccgggcatcgacgtcgcgatcgtgcatcgcgtcggcaggctcctgccgctcgaccagatcgtgatggtcgccacggttgcgtcgcaccgcggcgacgcgttcgcgtcgtgcgagttcgtgatggactacctgaagaccgaagcgccgttctggaagaaggaaaccacgccggacggcgagcgctgggtcgacgcgcgcagcaccgacgatgccgcgctcgcgcgctggggatcgaatcgggcaatacgcggcgctgagcgcggcgtcggcatcgtgcggcaaggtgccgcatgcacgcaagcgccgcgcgtgacggcaacccgtgacggcacccgttacgcgtccggatcggtgctgcgcccgatgatcttcgtcggaaacggctcgccgcgggcgcgcgacggcaacgcgtgcggatcgtcgccccgtcgtccccgccgcggcggcgcggtgcgatcgcgtcgagcagcgcctgctgctcgggcggaatccggtaatcccagccgaagcggctcagctgcaggctctgtgcgatccgcagtgccggttccatgaagcggatcgccgcgggcggtgcgtagcgcgcctcgacggtcttcaggaacagcgacagccagcggctgaaatgggcaggctcgatcccgtcgagcggctggtgcgcctgctgtacgttgccgcgatagcccttggtgccgagcacgaggctcgaccagaacgtgaccatcttcggcaggtggtcgtcccagcggccggccagctttgcgtcgaacacgggcccgagcagcggatcggtgcgcacgcggtcgtagaacgcgtagacgagatcgcggatgttctcttcggtcggctcggcgtcgcgagggcgggccggtgcggtatcgggcgaggcgggcaggacggtcatggcaaaaagggggccgggagagacagacaacgacggggcggcggcgcgggcatcgtgcaggacgccggccggattttgacgcaaaatagcgaccaacgacccctgaaaaacgtgtagatgtcacgcatcttattgcgcgcgcgccctcccggcaacccggggccgcggaacagggctgtcgaccggccccgtgcgcatcccgatcggcccggctcacgtaattgggacacgatcgatctcttccgtattcacccatgagactcaccgactacaccgactattcgctgcgcgtgatgctttaccttgccgtgcgcggcgagggactcgcgacgatccaggagatctcggacgcctacggcatctcgaagaaccatctgatgaaagtcgtgcagcagctcggcgagctggggtgggtcgacaccgttcgcggccgcaatggcgggctgaggctgttcccgaatcgctgcaactgaccgtcggtgaggtcgtgcgcgcaaccgagagcgatttcgcgctggtcggctgctttgcggccgaaggtgaatcgcgcggctgcgtgatcgagccgcagtgtcgcctgaagggcgtgctggcggccgcgcgcgatgcgttcttcgccgaactcgaccgtcacacgctcggtgaactggtcgaacccgctgcgccgctcatggcgctgctcggcattcgcccggtcgtgcgcatgcatcccgccgcgccgttgccggaagacgcgcccgtgtccgtcgagccgccgtcgacggccggctgatacgcgagcgccgcgctccgcggcccggcagcggcccgtccggggccgcttcgaggatatccatcgatttttgcgctgaatcaacccaaatttcgcttgaaagccgcataaccatccttatcttggtgttaatcgaaaattggaggtctcgacaaaatgagaatcgacaagctcaccaccaagttccaggaagcactcgctgacgcgcaaagccttgcggctggccgcgacaatcaatacatcgaacccgttcacgtgctggccgcgctggtcgcgcagcaggacggttccgcccgctcgctgatgtcgcgcgcgggtgttcacatccaggcgctgcaaggcgcgctgaacgaagcgatctcgcgcctgccgcaagtgacgggtacgggcggcgacatccagatcggccgcgaactggccgggctgctgaaccaggccgacaaggaagcgcagaagctcaacgacacgttcatcgcgagcgagatgttcctgctcgccgtgtccgacgacaagggcgaagccggcaagctcgcgcgccagcacggcctcacgcgcaagtcgctcgaagccgcgatcgccgcggtgcgcggcggctcgcaggtgcacagccaggatgcggaaagccagcgcgaggcgctgaagaagtacacggtcgacctgaccgagcgcgcccgtgcgggcaagctcgatccggtgatcggccgcgacgacgaaatccgccgttcgatccagatcctgcagcgtcgcaccaagaacaacccggtgctgatcggcgagccgggcgtcggcaagaccgcgatcgtcgaagggctcgcgcagcggatcgtcaacggcgaagtgcccgagacgctgaagggcaagcgcgtgctgtcgctcgacatggccgcgctgctcgccggcgcgaagtatcgcggtgaattcgaggagcgcctgaaggcggtgctcaacgacatcgcgaaggacgaaggccagacgatcgtcttcatcgacgaaatccacacgatggtcggcgcgggcaaggccgaaggcgcgatggatgcgggcaacatgctgaagccggcgctgtcgcgcggcgagctgcactgcatcggcgcgaccacgctcgacgaataccgcaagtacatcgagaaggatgccgcgctcgagcgccgcttccagaaggtgctcgtcgacgagccaagcgtcgaggcgacgatcgcgatcctgcgcgggctgcaggagaagtacgaactgcaccacggcgtcgacatcaccgatccggcgatcgtcgccgcggccgaactgtcgcaccgctacatcaccgatcgcttcctgcccgacaaggcaatcgacctgatcgacgaagccgcttcgaagatcaagatggaaatcgattcgaagcccgaagagatggacaagctcgaccgccggctgatccagctgaagatcgagcgcgaagccgtgaagaaggagcaggacgaagcgtcgcagaagcgcctgcaactgatcgaggaagagatcgagcgcctcggccgcgaatatgcggacctcgaggagatctggaccgccgagaaggccgcggtgcagggcagcgcgcagttgaaggaagagatcgagaaggtgcgtgcggacatcgcgcggctgcagcgcgacggcaagctggagaaggtcgccgaactgcagtacggcaagctgccgcagctcgaggcgcagctgaagcaggtcacgcaggccgaagagcaggagcagcacaacccgacgcggccgcgcctgctgcgcacgcaggtcggcgccgaggaaatcgcggaagtcgtgtcgcgttcgaccgggattccggtgtcgcggatgatgcagggcgaacgcgagaagctgctgcacatcgaggaaaagctgcacgagcgcgtggtcggccagcatgaggcgatcggcgcggtggccgacgcgatccgccgttcgcgcgcgggtctcgccgatccgaaccgtccgtacggctcgttcctgttcctcggtccgacgggtgtcggcaagaccgaactgtgcaaggcgctggcgtcgttcctgttcgattcggaagagcacctgatccgcatcgacatgagcgagttcatggagaagcacagcgtcgcgcggctgatcggcgcgccgccgggctatgtcggttacgaggaaggtggttacctgacggaagccgtgcgccgcaagccgtacagcgtgatcctgctcgacgagatcgagaaggcgcatccggacgtgttcaacgtgctgctgcaggtgctcgacgacggccgcatgacggacgggcaggggcgcacggtcgacttcaagaacacggtgatcgtgatgacgtcgaacctcggctcgcaggtgatccaggcgatgacgggggcgccgcaggaagagatcaaggacgcggtgtggctcgaggtgaagcagcatttccgccccgagttcctgaaccggatcgacgacgtcgtcgtgttccatgcgctcgaccgcagcaacatcgagtcgatcgcgaagatccagctcgcccgcctgcacgaccggctcgcgaagctcgacatggcgctcgacgtgtcgccggcggcgctcgaacagatcggcaaggtcggttacgacccgctgttcggtgcgcggccgctgaagcgcgcgatccagcaggagatcgagaacccggtcgcgaagctcatcctcgcgggccgtttcggtccgaaggacgtgattccggtcgacgtcaacgacggcaagttcgtgttcgaccgcgtcgttcactgatcgcctgccatcggctgcctgcccggttcgcgccgggcgcgcaaaacaaacaccccgcctcggcggggtgtttgcttatggggcggccgaaaccgccgccggggctgtcagccggcgtggtgcgggctcagccctgcttgttgccgccgaacatgccggcgagttgcgtgagcgcgccgagcacgttcgacgtatcgatctggccgcctgccggcacttcgccgttcggcgtcgcgccgttgacgacgtgcggcagcacctgcgcgaggatcgacgaagcctgcgacggatcgatgccgaccttgctcgcgagcgagccgacgacgtcggagccgagcacgttctgcagcgtgtctgccgagatcggctggtttcgccgttgccgacccacgagccgatgatgtcgccggcgccgcctgccttgaacttctcgatcaggccgttcaggccgcccggctggttgttgatgaattcgagcgcggtcgtgatcagcgcgctttgcgagttgccgccggcctggccgccgagcagaccgccaacgatgtcgaggagacccatggtgcttcacctttactgaaaagggcgtcgtgacgacgacgcccgttgaacgaatgccgcgcgcacgccgtcgcgcgcgcggcgcacatcaggcgcccgacgccgcggcggcggaggctgccttgtccttcttgcttttcttcttcgaacccttcgtcgccttggccgacgacgccgcggccggtgcgctcgcacccgcgtcggcggatgccgctgcggccgcggcggccttttccttcttcgatgcgcgcttggccttggccggtttcgccgccgtgtccggcgcgcttgccgccggtgccggcgcagtggccgtcgtaccggccgtcgcggtcgtggacgtcgacgcggtgcctgccgacgtcgttgccgacggggtcgccggtgtcgtcgcggccggcttcgacagcttcacgcccttcggcggcgtcgacgagccgccgatcgtcaggccgttttcctcgagatggccgaccgacttcgtgccgaggccctttacgcggttcgcgagatcgtccgcgtccttgaacgggccgttcttggtgcgttcgtcgatgatcgccttcgacttcacgggcccgagacccttcacggattcgagcgcggcctggtcggccgtgttgacttcgacggccgcggcaaggcctgcggcgagtgacagcgacagcgcgacgaacagcatcagcagctttttcagcatggcaaaggctccctggttctgattctgacggatgaatggctgttgcaacggacggcgggcgagacttggccgggcgtcgccgttaagcataggacaaatgcgtgcccttttaagacaggctgaccgaatcttgctgaaggcttgcggcgctgtaaagaccgaaacccgcgccgggcagcggttttgaccattctttacggtgtcgcggggtgtcgtgggtcgtcgtcgcgctggccgttcgaaagcgcttgacttagagttgactctaactcctaaccttgttcctgccatgtcgaaaaccgtatccaaaccttccgccaccggtccgctgacgatcgggcaagtcgccgagctgaccggcttgtcgacgcatacgctgcggtactacgagcaggtcggcctgctgcgtgcgatttcgcgcacggcggccgggcaccggctctatgcgccggccgaccttgactggctggccttcgtgatgcgcctgaaggcgaccggcatgccgatcgcgcagatgcaggaattcgcggcgctgcgcgcgcagggcgagccgaccttcggtgagcggcgccgcctgctggtcacgcatcgcgacgcggtgcgcgcgcatctcgcggagctgcaggcgagcctcgacgtgatcagcgacaagatcgcgtactacgaggcacaggagcgcgatgcggcacgacgggcaaaaccctctcactccccatcggaacaggacggacaccatggaacgactcgttgaagaccgctacacgcgcggctggaacaaactgaaggaaatcgacggggaggcgggcgaacgcgtgatcgcggcgctcgcgccgatcgccccggacttcgcacggctgctggtcgagttcggcttcggcgacatctacagccggccgcaactcgacctgaaggcgcgcgagattgcgacgatctcggcgctggccgcgctcggcaacgcgcagccgcagctgaaggtgcatatcgaggccgcgctgaacgtgggctgcacgcgcgacgagatcgtcgaggtgttcatgcagatgtccgtgtacgcgggtttcccggccgcgctcaacgcgctgttcgcggcgcgcgaggtgttcgcgcggctcgacgaagcggccggagagacaagcgacgcgaacgacgcggtcgggcagctcgcgtgacggggcgcgcgccggcacccgcacgtcacgcgcggtgcggcgcgacgatccggtgcttcgcgatgcgccggtacaacgtcgcgcgcgagatgccgagcgcctgcgcggcggcgtcgggccgccagcggtgcgcggtgagcgcggcgacgatgcggccgcgctcgtcgtcaggcagggtgccggtcgacgcgccgccgagctgcgcggcgagatcggccggcagatcctgtcgcgtcacgcgcgcggcgtcgcacaccgcgcacgcatagcgcagcacgttgcgcaactgccgcacgttgccgggccacggatacgcggcgagctgttccgcgagcgttgcatcgagtgtcagcacgtggccggttgcctgcgcctcctcggcgaacacggtggcgatcacgtcgcgcacgtccgcgcgctcgcgcagcggcggcagttcgaacgtcgcgccgctcagccggtagtacagatcctcgcggaacgtgccgtcggccaccatgcgtgcgagatcgcggtgcgtcgcgcagatcacgtcgagatcgacgcgcacgggcgtatcgctgccgagcggcacgacctcgccatcggcgagcacgcgcaacaggcgcgtctgcagcgcgagcggcatgtcgccgatttcgtcgaggaacagcgtgccgccgtcggcgagtgcgatcttgccgcgcgcgccgtgcttgcgcgcgccggtaaacgcaccggccgcatagccgaacaattcactctcgatcagtgcttccggcagtgcgccgcagttgacggcgacgaaaggccgcgcgcgccgcgcgccggcgtcgtggatcgcgcgcgcgaacacttccttgcccgcaccggtctcgccgagcacgagaatcggcagccgcttgctcgcgacccgcaacgcgagttcggcctgttgcgcgatatgcgcgtcactgctgtgcaggaacggcgtcagcgcgccgacgtggcgttgcgtggtgcccgggcggcgcgaggccgtgccgggctcgcggccggtgcgccgtagcggcgcgcgcagccgcgcatagagcggcgcgccggtcgcgcgcagccgcagcgcgacgatcgcatcgagccgcgcggcatcgcgcagcggcatctcggtcgcatcgaagatctcgtcgatatggcgcggttcgcgcagcgccggtagcgcgtcgcgcgcctgccggttcgcggcgacgatattgccgcattcgtcgaacgcgatcagccactcgggttgcgcttcgacgtagtgacgattcggatgcccgaacaggatccagtgctgcgcggtgctgtgcacgaagtagccgtcctcgatcagcgccgcgctttgccgcacgagctgatagacgagacgctggctgtcgcggccgtcgggcgattgaacggccgacgcgtcgagcacgccgatcagctcgccgcccggcgagaagatcggcgccgcgctgcaggtgagcgtcgtgaaggccgcgcgaaagtgatcggtcttgtgcacggtgatcggcgcgagatcggtcagcacgttcgcgacaccgcaggtgccttcctcgctttccgaccagcacgagccgatgtgcagccccgcgtggcggaagtcgttgcggcgctcgcggtcgatccggtagtcgatcgtcacgccgtgcgcgtcggtcagcatcacgcagtagtcggcgacgcggatcatgtcgtgcagccgcgtcaggcactggcccgacgcgcgcaggaaggcctcttccttgtcgcgcacttcgcgcagctccgccgcggtcagcacgcgcgggccgatcgacgaagcggggtcgagacggtagcgctcgagcgaccgttgccacgatgacacgaggcgcgtggattcggccggcgcgggcaggcgtccggcgagcgcgccgagcacacggtcggcgtgctgggcctggggacggcgtaaggcatggtcggctccggttccgtacggcggggaatgcgatgttcttgtagcacatcccgttcgacggatcacattgcatcgcagcacgcggcgggcgtgagacgttcgtctcaccggtatcgcgcgctgtctcgtgtcgctgagacgcgcgcatgtgcggcatgcgcggatcgtccggcatgacgcggcccgcacggcgccgcgatagcgcggggtttgcgggcgcaacggcgcgcttgcaccggcgtcgcggtggccgttttgttgcatcgacggggtgagacgaacgggcggaattgccgcgcgcgccgtggctccggcagcgaaccggcggcgtcgacatgcccgccgcgccagcgtgcacacgggtttcacggacatcgcacgctcgatggcacgccgcttgcagagatcacgggcaggtcggtgcggtcgcgtcgacgatgaagatccgccgcccggcgatggcagcggacgagacaggcagggccgcggcgtacagcaatgcgccggggccggccaactggatggagacgaacccgtgacgacgcccgttaccgtcggtgtgatcgcgaaccccgcatcggggcgcgacatccgccgcctcacgacgcatgcctccgtgtttccgacggcggagaaggcgaacatgatcgtgcgcctgctggccggcctcggcgcgatgggcgtcgagcgcgtgctgacgctgcgcgaccgcacgggcatcgcgacgctgctgctgcgcgcgatcgacacgcatcgcgcggtcgcgccgcacgagcgctggcccgaggtcgaattcgtcgacttgccgatcaccgataccgtcgccgacacacaggccggtgccgcgtacctgcaccgcatggaagtcgcgctgatcgtcgtgctcggcggcgacggcacgcatcgcgccgtggccgcgcactgtggcgcgacaccgctcgtcgcgctgtccaccggcaccaacaacgcgtttcccgaacatcgcgaggcaaccgtcgcgggcgtcgcggcaggactcgccgcgaccggcgcggtgccggccgaagtcgcgttcacgcgcaacaagcggctcgtcgtgcgctgcgtggcgggtgcgcagccggggcgcgaggagatcgcgctcgtcgacgtgtgtgccgcgcgccagcgcttcatcggcgcccgcgcgatctcggggtccgacgacatcgattcgctctacctgacgttcgcggaaccggacgggatcggcctgtccgcgctcggcggcgcgtgggcgccgctcgaacgcagcgcgccgcacgggctcgcgatgcgcttcgcggccgaaggcaaggcggccggcacgccgctcgtcgcaccgattgcgccgggccgcgtcgatcgcgtcgtgatgcgcagttgcgaacggctcgagccgggcgcgtggcagacgatcccgttcgagcgcggcacgctcgcgttcgacggtgaacgcgagatcgaggtcgcgcgcggcgatcgctacgagatctcgctcgactggcgcgggccgctgacggtcgatgtcggccgcacgctgcgctacgcgtcgtcgcggcaactgctgcgcgatgccggcgcgtggcacgactgagccgctgctgtttcgcatgacgtttcgatttccataacgatcctcaaggagacattgccatgacggcttcactcgaaggacaggttgccatcgtcacgggcggcgcacgcggcatcggccgcggcattgcgctgacgcttgccggcgcgggcgccgacgtcctgctggccgacctgctcgacgacgcgctcgacgccaccgcgcgcgaggtacgcgcgctcggccggcgggcggcggtcgcgaaggtcgacgtcacgcaggccgcgcaggtcgacgcgatggtcgcgcaggcgctcgccgaactcggccggctcgacatcctcgtgaattgcgcgggcgtgatcagcattcatccggtcgccgaactgaccgagcgcgactgggatgtcgtgatggacgtgaacgcgaagggcaccttcctcggctgccgcgcggcgctcgcgcacctgaaggcgcagggccgcggccggatcatcaacgtcgcgtcgatcgccggcaaggaaggctttccgaatctcgcgcattacagcgcatcgaaattcgcggtcgtcggcttcacgaacgcgctcgcgaaggagcttgcgcgcgacggcgtgaccgtcaacgcgatctgccccggcatcgtccgtacctatatgtgggaccggctgtccgacgaatggaaggccgacggcgaaacggtcgaggaatcgtggcagcggcaccagttgacgctgatcccgcagggccgcgcgcagacgccggaggacatgggccggctcgcgctgttcttcgcgacgatggacaacgtgacgggccaggccgtgaacgtcgacggcggcttcacgttccactgacggccgcaggccgtgcaatccgtcgccacggcatcgccgcggcggcattcgcagtcagacctacccaggagacacacatgaccgtttcgacacagctcagcagggacaagctgctggacgcctaccggctgatgcgcacgatccgcgaattcgaggagcgcctgcacgtcgaattcgcgaccggcgagatccccggcttcgttcacctgtacgcgggcgaggaggcgtccgcggtcggcacgatactgcacctcggcctcgacgactacgtcgcgaccacgcaccgtggccacggccattgcatcgcgaagggcgtcgacgtgcacgggatgatggccgagatctacggcaagaaaaccggcgtctgccatggcaagggcggctcgatgcacatcgccgacctgtcgatggggatgctcggcgccaacgggatcgtcggcgcgggcggcccgctcgtgtgcggcgcggcgctcgcggcgaagcacaggaagacgggcggcgtcggcgtgtgctttttcggcgacggcgcgtcgaaccagggcgtgatcttcgaatcgatgaacctcgcgtcggtgtggcggctgcccgcgatcttcgtcgccgaaaacaacggctacgcggaggcgacgtcgtcgagctggtcggtcgcgaccgacaacatcgccgatcgcgcgaacgggttcgggatgccgggcgtgatcgtcgacggcttcgacttcttcgcggtgcacgaagcgctcggcgaagccgtcgagcgcgcgcgcaacggcggcggcccgacgctcgtcgaggtgaagttcacgcgttatttcggccacttcgaaggcgatgcgcagacctatcgcgcacccggcgaggtgcagaagctgcgcgacgagaaggactgcctgaagcatttcgagacgcgcgtcgtgcgggccgaagcgttgacgaccgccgatctgcgcgcggtcgatgcccaggtgaaggcgctgatcgacgacgcggtcgcgcaggccaaggccgcgccgctgccggacgcggccgacctgctgaccgacgtctacgtgtcgtacccgtgagcgcggcctgacaccgcggccgacacggcgaaccgaacattccaggagacagacatggcaaggaagatcacttattcgcaggcgatcaacgaggcgctcgcgcaggaaatggcgcgcgacgacagcgtgatcgtgatgggcgaggacaatgcaggcggcgcgggcgcgccgggcgaggacgacgcgtggggcggcgtgctcggcgtgacgaagggctgttccacaaatttccgggccgcgtgctcgacacgccgctgtcggagggcggctacatcggcgcggcggtcggtgcggccgcatgcgggatgcggccggtcgcggagctgatgttcatcgatttcatgggcgtgtgcttcgaccagatcttcaaccaggccgccaagttccgctacatgttcggcggcaaggccgtgacgccggtcgtgatccgcgcgatgtacggcgccgggctgcgcgcggccgcgcagcactcgcagatgctcacgtcgctgttcacgcacatcccggggctgaaggtcgtgtgcccgtcgacgccgtacgacgcgaaggggctgctgatccaggcgatccgcgacaacgatcccgtgatcttcctcgaacacaagctgctctatacccgcgaaggtgacgtgccggaggagtcctatgccattccgttcggtgaggcaaacgtgatgcgcgacggcgacgacgcgacgatcgtcacgtacggccggatggtgcatctcgcgatggacgcggccgcgaagctcgcgaaggacggcatccaggtcgacgtgatcgatctgcgcacgacgtcgccgctcgacgaggaaacgatcctcgaaagcgcggagcgcaccgggcgcgtcgtggtcgtcgacgaagcgaacccgcgctgctcgatcgcgaccgacatcgccgcgctcgtcgcgcagcgcgcgttccatgcgctgaaggcaccgatcgagctcgtgaccgcgccgcacacgcccgcgccgttcgcgagcgtgctggaagacctgtatatcccgtccgccgatgcgattgcgcaggcggtcctgaagacgaggagctgacacgatgtcgattcacatgatcacgatgcccaagtgggggctgtcgatggagcaggggcaggtcaacggctggttgaagacgatcggcgaacgcgtgacgaagggcgacgaagtgctcgacgtcgagaccgacaagatctcgtcgggcgtcgaatgcgcgttcgacggcacgctgcgccggcaggtcgcgcaggaaggcgagacgctgccggtcggcgcgctgctcggcgtcgtcgcggcggccgatgcgagcgatgcggacatcgacgcggcgatcgccgatttccagcgcgacttcgtgccgagcgcggcctccgacgaagcggccggcccgcaacccgagaaggcgcagatcggcggccggacggtgcgcttcctgaagctcggcgaaggcaccggcacacccgccgtgctgattcacggcttcggcggcgacctgaacaactggctgttcaatcacgcggatctcgccgcgcaccggcccgtgtgggcactggacctgcccggccatggcgaatcgggcaaggcggtcgagacgggcagcctcgacgaactcgccgacgcggtgctcgcgctgctcgatgcgaagggcatcgaccaggcgcacctgatcggccattcgatgggcggcgcggttgcgatggcggcagcggaacgcgcgccgcaacgcgtcgcgtcgctgacgctgatcgcgagcgcggggctcggcactgacatcaaccgcgcttacatcgacggtttcgtcgccggcaacagccgcaacacgctgaagccgcacctcggtgcgctgttcgcggacaacgcgctggtcacgcggcaactcgtcgaggatctcgtcaagtacaagcggctcgaaggcgtgcaggccgcgctcgagaagatcgcgaacgcggcgttcgacggcgccgcacagcggcgtgtgttccgcgaccggctcgcgacgcttgcgccgcgcacgctcgtgatctggggcgagcgcgaccaggtgatcccggcgcatcacgcgcaggctttgcccgacggcgtgcgtgccgaagtgatcgccggccgcgggcacatggtgcagatggaggcggccgccgacgtgaaccgcctgatcgtcgcgttcctcggagactgacgatggccgccgcgctcgaacgacccagcctcacggcgctcggccagccgggcgcgagaagccgcgacaagctcgcgcgcattccggtgcgcgtcgagcccgcggccggcgcggcgctgccgaagccgccttggctgcgcgcgcggccgatgatgagcgcggcggtggccgacatggctgccgtgctgcgcgaccatcggctgcattccgtctgcgaggaggcgatgtgcccgaacatcggcgagtgcttcgcgcagcgcaccgcgaccttcatgatcatgggcggcctgtgcacgcggcgctgcccgttctgcgacgtcgcgcacggtcgtcccgagccgctcgatcccgacgagccggcgcggctggccgacacggccgcggcgctcggcctgcgctacgtcgtgatcacgtcggtcgaccgcgacgacttgcgcgacggcggcgccgcgcatttcgccgcgtgcatcgcggcggtacgtgcgagcgtgccgggcatcggcgtcgaagtgctgacgccggacttccgcggccgcgtggcccgtgcgctcgatgcgctgtcgacggcctggcccgacgtgttcaaccacaacatcgagacggtgccgtcgctgtatcgcgcggcgcgaccgggcgccgactatcgcggctcgctcgaattgctcgcgcaggcgaaggccgcgcggccgacgctcgtgacgaagtcgggactgatgcttgggctcggcgagcgcgacgacgaggtgcgcgacacgctgcgcgacctgcgcgcgcacgaagtcgacgtgctgacgctcggccagtatctggcgccgtcggcgcaccacctgccggtgcgacgctacgtgagcccggaggcattcgccgcgtggcgcgacgacgcgctggcgctgggtttcagggaagtcgtcgccggcccgctcgtgcggtcgtcgtaccatgcggccgacgtgctggaggacaggtagcgggcggcgcgtcaggccgacgccggggcgtgcgcgcgactcacgcggcgcaggtacagcacgagcccggcgcccgcgagcatcaggctgaccgtgttcgcgaaccagaagccgcgcgcgccggtcagccacgcgggcgcgatgccgcccacgtcgaagccgagcacgtagccgccgctgagcccgacgccccacagcgcgaccgcatagatcacggtcggcacgaccgcgaccttgtaggcccgcagcacgaacgccgacgtgacctgcagcgcatcgaagacgtggtagcacgtgacgatcgcgacgagcggcatcgcggccgcggcgacggccgggttcggcgtatagccgccgatgatcagcggtcgcagcacgaacacgagcaggccgtatgtcgcggcaatgccgcacgcgaagatcacgctgtggcggccgagcagccgggcttcttcgggccgtccggcgccgagcgcgcgcgcgaccagcgtcgacgccgccacgccgatcgacagcggcgtcatgtacagcaccgcgccgatgttgccggcgatctggtggccggcgagcgtcgtcgtgccgaattgcgcgatgaacagcgccatgcacgtgtacgacgtgacctcgatcaggtacgacaggcccatcggcacgccgagtttcaggatcgccttctggcgttcccagaccggccagcagaagcgcgagaagatcgcgagcggcgcgaacacgtcgagcttcgcgagcagcgtgtagccgatcagcgcgagcgcccagttgatcagcgtgctcgcgagcccgcagccggggccgccgagggccggtacgccgaacccgccgaagatgaaccacacgttgagcggaaacttgagcaccagcgcgccgatctgcaggatcatcgcgaggcgcggcttgccggccgcgttggtcagcgcgttgtagatgcggaagacgaggctggcgggcagcccgtacgacaggatgcgcaggtagtcgacggtgcgctcgtgcagcgcggcgggtgcgtgcgcgacgcgcagcagcggttcgggaaaatgcagcaggagaaagccgggcaccgcgagcagcagcgcgagccacagcgcctggcgcacttcctcgccgatttcggcatagcgtcgcgcaccgtacagttgcccggtgatcggctgcagcgcggacaggatgcccgtcaggccgatgtagatcgacacgtagatcgacgagccgagcccgagcgcggccagatcgacggccgagtagcggccgaccatcgcggtgtcgatcacgccgaacgcgatgatcgcgagctggccgacgagcaccggccatgcgagaccgacgattcggcggatgtcgccgaacatcgtcagtcggccggctgacggcgcggcggacgccgcttgacgggcgtcttcggccgttcgatgcgctcgtacaggcggaagcgctcgtcgcggtcggcgacgcggcggccttcccacacgagacgccacacgtattgcgacatcgagctcggctcgccgaagtccgcgcggtcctggcgcaggatcacgtcgcagtcgccggagaaatcgaagcgcatgttgccgaaatacgcgaaggtcgcgatctgcgcgtcaccgagccgcacgggcgcgatgcactcgtagtcggacggcaggtgcacggcgatctgctgcgcgacgtcgcgataggtccggccgtaattgacgatcggcagccacagcgtcatcagcagcacccacatcagcgtggtgccggcacccgacagcacgacgctgcgccacagaaccttcggctgccgcgagatgcgccagcgcacgaggaagcaccagcacaccgtggcgatgaccgcgcagacgaacgacaggatcttgaagtgcggctcgtagccgggcacgaggcgcgcgaggttgcgggcgagcggatgcgggaagcccgtgagcgaggcaagccacacgagccacacgaaggtgccgatgatcgtgaagctcagcaccgcgaaccagtcgatcgcgttgatcgcgccgcgcttgagggtcggcagcgcgaacgtcgcgagcaccgcgagcggcggcatcagcagcatgtacatgcggttcgactgctggctctgcaggatcacgagcgcgacgagcggcacggcgaccgacagcggaatcgcgacgtgcgcgcggcggcgcatgccggcccagctccaccatgcccagatcgcgagcggccacgcgggccacgtgaacagcggcaggttctttgccgcatagccgagcacggcggtcggcgggccggaaaagcgcatcaggctgccgtgaatccactggttgaagaaccatgcggcgtcgtcgggcgccgcgacgaacgcggcaagcggccacagcgcgaagatcgcggccgcgagcggtacgccgaccagcggcaggcgcaggttgcgcatctcgggcgtgacgagccacagcacggccgtgccggcgagcagggcgacgacgagcaccgggttgccggacagggcgacgaggccgatcgcgagcccccaccacagtgcgccctgcatcggcttgtcgatgccgcggacgatcccgtagacgagcatggcgatccacgcgaactgcgccagctgcggcgtcgtttcgtgtccgcgctccgcgaggccgaagcaggcgacgagcacgagcagcgcgccgtcggcgagcgtgcggccgtagtcgcgcggctcgggttcgccgccgaatgcgtatttgaacggctggacctcggcacgccgaccgagcagataggctgcgtaccagacgaacgcgcacgcgacgcagaacagcacgccggtatcgacgcgcgacgcgttgctcgcatcgacccacgggccgaggccgcggatcgacagcgcgccgagccagtagccgagcggcccgtcggtcgtgatgaacttgccgacgaggttcggcagcagccagtcgtgccagccgcccttggccatcgtccacatcacgccgaagcccgccgcgtcctcgttcttccacggatcgcggccgaacaggccgaacgctgcgtagacgaagcagagggtaagcagcagccagcgcggcagcgcacgcgtggcggaggcggtgagacggacgacaggcttcatgcagatgagcgatttgttatgggcgggcggccggcgcgggtgcgcgcggtcgagccggtttcgagcatccggcattgtagacgcgccggcagttgcgcgtcaggccgatgcccggacgccggccggcgctttcccggcgagcagagacaaaaagggcagcctgggctgccctttgtgcgataccggtgcgttgcaaccaccggatgcggtgcaaagcttacttcgccttgccgctggcgcgaacgccgaacttgttcttgaacttctcgacacggccggccgtgtccatgatctttgctgacccgtgtagaacgagtgcgattccgacgacacttcgatcttggcgagcgggtaggtcttgccgtcgagttcgatgttttcacgcgtctggatcgtcgagcgcgtgatgaacttgaagccgttcgacatgtcttggaagacgacttcgcggtaatccgggtgaatgccaggtttcatgattttccttggtgagagcggtagccaacccgccgcttgccgtgccgtgccgcacaaagttgcgcgatccagccgacgtcaagcccggcgcgagccacttgcctaaggtcgaaaaacggcgattatgccagaaaatcagatggttgacgaattattttcacggtgcgtcgagtgcgccggtgccggccggatcctgccggtagtagcgcgcgagcagccggtacagctccggaaattcggactcgaacgctttcggccttacgaacagcgcttcgctgcacaccgcgaagaattcggacgggtggtcggccgcatacggatcgatcagcgattcccgctcgaagcgtgcccacgcgcggtccggcaccgcgtcgacgcgcgcgcagaactggtcgtatgcgtgctcgaacacgtcggcccaggcctgcgcatcgaggtacggcgcgtgccagcggcgaaaaagggcggatagccgtcggctgcgccgttgaccatgtcgatcttgtgcgcgaactcgtggatcacgacgttgtacgcgtcgcggccgtccgtcatctgcgcatcctcccacgacaggatcacggggccgccttcccaggcctcgccgctcgcgtcctgctccacttcgtggacgacgccgtcctcgtcctgcaccgtcttgcggatcacgaattcgcccggatacacgacgacgccgacccagccgtcgtacagcgacaggtcgagattcagcacgggcaggcaggcctgcgcggcgatcgcgacgatcatcgcgtcggtcagctcgagcccgtgcgcggtcgagaacgatttcttcgcgacgaacaggctcgtcagttcgcgcagccggccgagcgcgtcgggcgacagcgccgcgaggaacggcaggcgctcgacggtgtcctgccatagcgcgtcggggatcggatggctgcgcagcgcgcggtcgcggcggcggtcgtcgaaccagcgggtcagtttcgagagcatgaaggcggctcgcggaaatccaaagcctgtcttttaactcaatcgatctcttttgccatgccgcgaagaggccgccgacgagcgccacgccggccaggaagtaaagccgtcgagcgacgccagaaacgacgcctgttgcgcgaccatgcgcgcgatcgacgcgatcgcgagcccgtgcgcgtcgttcagcgcgtggccagcggccgcatagctgcgcgtcagcgcatcggaggtctgctggaacagcggatcgaacacgttcgcacgctcgacgagtcgcgtctggtgcacggccacgcggtgctgctcgacgatgatcaccgacgacgtcgcaaacgagatcgtcagttgccgcacgatgttcttcagccggtagccgtgcgtgtattcgtcgatcgcgaagatccggaacgtcaggttggccaccggcagcacgatgaagagcaggagcagcccgcgcagcagcagcgggacgatcagcgcggcttcgccgacctgcggcgtcattcgcgtcatccacagcgcggccgtgatggcgatcgcgaaccccggcacgacgaaccacttcttgtgcgtgacgagtttcgcgtaacgcaggtaggcgaacagcgcggtggacgaaatcagcgacatcgtgccgacgagccgcccggcgttctcgaccggatagccgagtccgccttcgagaagccgcgaggtcaggtaactgaagcctgtcgactcgtagtaatagaacatgtagagcagcagcccgacctggaacgtccgttcgcggaacgcgtgaaggcgcacgagcggcgtcggatggttccactggtgatacgcgaaccacgcgagcgcgccgatccccgcgatcgtcagcaggatcagcatcggcgagccgctgtagagctggtaatgcacctgctgcagcacgatctgcagcgcaccttgtgcgagtgcgaacacgacgtacggccagaagtgtccggaaccgcgttcgtcgtccggcgtccggcccgagtcgggcagcgtgagtagcgcgaggatcgcgaacgcgatgccggccggcgccgtgcatgcaaacagtgcacgccatgtcgaatgcgcgacgagcaggccgcccacgatcggcgcgagcgcgctgccgagcaggatcatgatgaggaacgcgcgcgtcgcgggcggccgttcctgcggcttgaaactgatctggatcaggatccggcacgcgcccatcatcgggccgatgaaatatccctggaatccgcgcgcgaacgcgagttcgagcgacgtgtcggcgagcgcggccgcgatcgcgccgaacgagaacatcagcatgcagcctgcgacgtagcggcgatggccgagccggtcgacccaccattgctgctgcagaatgccgagcacggccgtgaccgcgtaagcgctcgacgaccacacgagttcgtcgggcgaagcgttgatgccgcccgcgatgtagctcgcgaagaacgagaaggccgcgttgtcgaaatagtcgatgccggtgacgagcgcgagcgcccacgggaacaggtccgcgcgcaggttcgcgcggctccatagcggcgggcgaccgggcatcgcgttcattcgcgagccttgcgcgcgcgccgcgtgccgctttcggcctgccgctgcgcgatcagcgcgtcggcgttttcgccggcaagacgccgctcgacgtagtcgatgtcgtgctgcagttccttgcgcagcgcgacggcttccttcagttcgcgctggacggccgcgatccgccgatcgagcgtatcgatctgctcggcgaggccggtacggatgtcgcgcagcgacgcttccgagtagcggcgccggccgtcggccgtttcttcgagcgggcgcttcagcatttcggtgatgccgtgcagcgaagccgagcgcgcgcagccgcaggatgcgcgcgaagcgctcgaggtcggcttcgtcgtagaggcggtagcggccctcgctgcgcgacggcgtgacgagcccgcgctcctcgtaatacttcagcgtgcgcggcgtgacgccgagtcgcgacgcggcatcgctcacggtcagcaacgggttggaggtgtcgttcggcatggggcgtggagggaattcgatccgggcgatggcgcgattatagataaacctgtacgttcacgttcaggttggcaccgaaaaacggccgccgggcaggatgcgcgggcggccgtttttcggtgcgggcggggcgcttagccgccgcggcgcatcaggtcgaagaactcggagttgctcttcgtctgacggatcttgtcgagcaggaattccattgcctcgacttcgtccatgtcgtggatgaacttgcgcagcacccagatcttctggaggatctcgggcttgatcagcatttcttcgcggcgcgtgcccgacttgttcaggttgatcgacggatagacgcgcttttccgcgaggcggcgctcaaggtgcacttccatgttgccggtgcccttgaactcttcgtagatcacgtcgtccatgcggctgccggtttcgatcagtgcggtgccgatgatcgtcagcgagccgccttcctcgatattgcgcgccgcgccgaagaagcgcttcgggcgctgcagtgcgttcgcgtcgacaccgcccgtcagcaccttgcccgatgccgggatcacggtgttgtatgcacgtgcgagacgcgtgatcgagtcgagcaggatcacgacgtcgtgcttcatttcgacgaggcgcttggccttctcgatcaccatttcggcgacctggacgtggcgtgtggccggttcgtcgaacgtcgaggcgatcacttcgcccgcgaccgagcgctgcatttcggtcacttcttcaggacgctcgtcgatcagcagcacgaacaggatcacgtccgggtggttctgcttgatcgcgtgcgcgatgtgctggagcatcacggtcttgcccgacttcggcgatgcgacgagcaggccgcgctggcccttgccgatcggcgcgatcatgtcgatgatgcggcccgtgacgttctcttcgccgcgcatttcgcgttcgagcgagagcggcttgttcgggtgcagcggcgtgaggttctcgaacatgatcttgtgtttcgaggcctcgggcggctgcccgttgactttgtcgaccttcaccagcgcgaagtagcgttcgccgtccttcggcgtgcggacttcaccttcgatggtgtcgccggtgtgcaggttgaagcggcggatctgcgacgggctgatgtagatgtcgtcggtgctcgcgaggtacgacatttccggcgagcgcaggaagccgaaaccgtccggcagcacttcgagcgtaccgtcaccgaagatcgtctctcccgtcttggcgcgctttttaagaatggcaaacatcaactcctgcttgcgcaggcggttcgcgttttcgatctcgaggccattggccatttcgatcagttcggacacgtgcagagacttgagctcggataaatgcatacggagaacccgccagggaggagacgacgaaagaaataaagggaggagggcgagcggaagcgctcagagacttaaatgcgtcttgtagacgtttttgattctagcataggccgattcgcgcttgagcgagcgaacggcggcttgacggcggacgtgttgccggttgacaacacgtccgcggaactgccggtattacaggtggctgtccaggaatgcggtgagctgcgacttcgacagcgcgccgaccttctgcgcggcggccgcgccattcttgaacaggatcagcgtcgggatgccgcgcacgccgaacttggcgggcgttgcttggttgtcgtcgacgttgatcttcgcgatctgcaacttgtcgccgtagtccttcgcgacttcgtcgaggatcggggcgatcatcttgcacgggccgcaccattcggcccagaaatcgacgagcacgggcttgtcggacttgacgacgtcctgttcgaacgatgcgtcgctgatgtgtttgatctgttcgctcattgggtcaatacctcttacggttcggggactgcctgcttgcgcgttgcggcgtaccggccgccgttggctgccggccgctgcggcaggtcactccgctctccggacaggagggtgtaagcgctgcatgccgcggctcgcgggtcgttcgggcgtcatattagcctaaattgctatctgctgcgggcggcgatagtagccgctacgcgagtaggggtacgacgcgccgttcgaccgttgtgccctgcaggtggaggccggcccgtaaattacaaggggacgcaggcaattcggtgcgggcgagcgtcgtgcgacccgatgcgcgccggtttgtccggtcatattcgcattggtgcgaacaaacggtcgcattcatccggaagcggtgatagaatgtgccgtgacgggcctcctcgcatggtggggcggtgaacctggtcaggtcgggaacgaagcagccacaatcgttttccgccagtgccgagggtcgggctcgtcaccttccttctcgccccgttcgccgggcgtttttatttctgcaccacactccgttttacctgcgcgttgcctgtctttcgcaccgtttcgcgtgtcggcgcgacgcagcgttactgatacaatttcccgatgacctatcaagttctcgcacgcaagtggcgtccgaaggatttcgcttcgctcgtcggccaggagcacgtcgtcagggcgctcacgcacgcgctcgacggcgggcgtctccatcacgcctatctgtttaccggaacccgcggtgtcggcaagacgacgctgtcgcggatcttcgccaaggcactcaactgtgaaaccggcgtcacgtcgcagccgtgcggcgtgtgtcgcgcctgtcgcgagatcgacgaagggcgtttcgtcgattacgtcgagatggatgccgcgagcaaccgcggcgtcgatgaaatggccgcgctgctcgagcgcgccgtgtacgcgcccgtcgatgcgcgcttcaaggtctacatgatcgacgaagtgcacatgctgacgaatcacgcgttcaacgcgatgctgaagacgctcgaagagccgccgccgcacgtcaagttcatccttgcgacgaccgatccgcagaaaattcccgtcaccgtgctgtcgcgctgtctgcagttcaacctgaagcagatgccggccgggcacatcgtgtcgcatctcgaacggattctcggcgaagagcacatcacgttcgagccgcaggcgctgcgcctgctcgcgcgtgccgcgcagggcagcatgcgtgacgcgctgtccctcaccgaccaggcgattgcctattcggcaaacgaggtgaccgagtcggccgtgtcgggcatgctcggcgcgctcgaccagacttacatggtgcgtctgctcgacgcgcttgccgcgggcagcggccccgaaatccttgcgattgccgacgagatgtcgctgcgcagcctgtcgttctcgaccgcgcttcaggatctcgcgagcctgctgcaccggatcgcgtgggcgcagttcgcgccgggctcggtgcttgacgaatggcccgaagcgggcgacctgcgccgcttcgcggagacgctgagccccgagcaggtccagctgttctatcagatcgcgacggtcggccgcgcggaactcggcctggcgccggacgaatacgccggtttcacgatgacgctgctgcggatgctcgcgttcgagccggctgtggcaaccggcagcgcgccgagcggacagccgtccgtgccgcgtgcggtgccggggccgcgcgtggcggcggcatcggctgccgtggcgaagccggtatccgccgcacctgtcgaggcagcgcggccgcaggctacggcaacggccgcgccagcggcgccggcaccggctggcggcgaagcagaccagccggctgagaagccggctgccgtcccggcatccgcgccggccccggttgatgagccggtcgtcgaaacgccgcagccgcgcgtggccgcagtaccgcaagcggagccggccagcgagaggccaacacccgcccgcaatgaacccgagccgccggctgcgccggccgaaccggtgccgcgcgctgcgtcgcccgagcccgccgcccgtccggcagcgcgttcaggggagccgccgccgcgctggacgtgctgcgcaatgcggggatgcgcgtgtcgtccgaccgcggtcgcgcaggcgccgccgcgaaaccggccgcccagccggccgccgagaagcccgtcgcgccgcgtcccgccgccgtacaggtacccacgccgcgtgcggcggcccgtgcgccgcaggcagccgatgcacgtcaggccccgccgccgtgggaggacatcccgccggacgaatacgtgccgctcagtgccgacgagatgtttggcggcccacccgacgacggcttcgtgccggtattcgacagcggccccgacgatgtgcgcgtgacgccgaagccggcggaagcccgcccgtccgctccggtcgacacgcgtccgctgccgcccgcgatcgcgctcgatccggtcggcttcgacggcgaatggccggcgctggccgcgcggctgccgctcaagggcgtcgcgtaccagctcgcgttcaacagcgagctgacggccgtcgatgcgactacgttgaaactttcagtgccggtgccgcaatatgcggacgctgcgcaggtggcgaagctgaaggccgcgctggccgatgcgctcggcaaaccggtcgaggttgccgtcgaagtcgggcccgcccggcgtacggcggcggcactcgatgcggctgcgcgcgcagcacgccagcgtgaggccgaacaggagattcacggcgatccgttcgtccagcagctcgtgcgcgacttcggtgcgcgcatcgtcgagggttcggtgcgcccgctcgccgacgcggcgccggacggcccgccgccgacgctgcattgaactgagcgccccgcgacaggcacaatcacgcccacacattggccggcacgcgccgcgtgccggttttcacacgatcaagaaggagtattcccatgttgaaaggcaacctcgccggactgatgaagcaagcgcagcaaatgcaggaaaacatgaagaagatgcaggagcagcttgcgctgatcgaagtcgaaggacagtcgggcgccggcctcgtcaaggtgacgatgacgtgccgcaacgaagtgcgtcgcgtgtcgatcgacccgagcctgctcgcggacgacaaggacatgctcgaggatctcgtcgcggctgcgttcaacgacgccgtgcgcaaggccgaagcgacgtcgcaggaaaagatgagcggcatgacgtccggcctgccgctgccccgggcttcaagctgccgttctgaacgcggcgtccgtgccactttgccgccgtatgaaacagccgtccgccctgtccgctctcgtcgaagcgttgcgcgtgctgcccggtgtcgggccgaaatccgcccagcgcatggcggtccacctgatgcagcacgatcgggagggcgcggagcggctcggccggtcgctgctgttcgcgaccgagcacctgcagcattgcgagaagtgcaatacgttcaccgaagcgcagatctgcgaggtctgcagcgacgaagagcgtgatccgacgctgctgtgcgtcgtcgagacgcccgccgaccagatcatgctcgagcagacgatgacttaccgcgggctgtatttcgtgctgatgggccggctgagcccgctcgacgggatcggcccgaaggaaatccatttcgaccgcctcgtgcggcgcgcgtccgacggggtcgtcaaggaggtcgtgctcgcgaccaacttcacgaacgagggcgaggccactgcgcactacctcggccagacgctgaaggcgcgcgggctcgcggtcacgcgcctcgcgcgtggcgtgccggtgggcggcgagctcgaatatgtcgacgcgggcaccatcgcccgcgcgatgctcgaccgccgcacgatgtaagccgggcgccgccggtcggcggcgccgttcctcatgccagggagacacatgagcaccagccagggcccgctcgcgggcgtcaaagtgctcgaattcggaacattgatcgcggggccgttcgcgtcgcggctgttcgccgaattcggcgcggaagtgatcaagatcgaggatccgaacggcggcgacccgctgcgcaagtggcgcaagctccatccggagcagggcggcacgtcgctgtggtggtccgtgcaggcgcgcaacaagaaatcggtcacgctcaacctgaaggccgacgccggcaaggcgatcgcgcggcaactcgcgcgcgaggccgacatcgtgatcgagaatttccgcccgggcctgctggaaaagctcgggctcggctacgacgtgctgtcggccgagaacccgggcctcgtgatggtgcgcctgtccggctacgggcagacgggcccgtaccgcgaccggcccggtttcggcgcgattgccgaatcgatgggcgggctgcgccacatcaccggatatcccgacctgccgccgccgcgtatcggcatctccatcggcgattcgatcgccgcgctgcatggcgtgatcggcgcgctgatggcattgcatcaccgcaaggtcaacggcggcgcggggcaggtggtcgacgttgcactgtatgaagccgtcttcaacatgatggaaagcgtggtccccgaatacggtgtgtacgggatggtgcgcgagcgcaccggcgcgtcgctgccgggtatcgtgccgtcgaacacgtatgcatgccgcgacggcagtatcgtgatcggcggcaacagcgacccgatcttcaagcggctgatgaaggcgatcgagcgcgatgacctcgccgacgatcccgcactcgcgcaaaacgacgggcgcgtgccgcgcacgcaggagatcgacgacgcgattgccgcatggctcgcgccgcgcacgatcgatgaagcgctcgtcgtgctcaacgcggccgatgtgcctgccgggcgcatctacagcgccgccgacatgttcaccgatccgcagttcgtcgcgcggcagatgatccagcgcttcaagctggccgacggcaccgacattccgttgccgaacatcacgccgaagctgtcggacacgccgggcgaaacgcgctggctcgggcctgaactcggcgagcatacggacgaggtgctgcgcggcctcggctacgatgcgcaggcgattgccgcactgcgcgacgcgggtgcgatctgaacgcccctgggcccgtcgcctcgcgccgggctccccgaagggcacattccgcaagcgagcgccgttggtgctggaaaacccggggcggcgaggcgttttcctgagcgcgcagaacgccgccgcgcaacgcggcggtgcagcgcgtacggtcgcccgcaaccgtccttccgcagtcgccggactgtcgctctcgcgccatctttcctcggttacaatcgccggatgcgaatcctactcagcaacgacgacggctatctcgcccccggtctcgccgcgctcagcgacgcgctgcggccgctggccgaactcacggtgatcgcgcccgagcagaattgcagcggcgcgtcgaattcctcacgttgtcgcggccgctgtcggtgcagcgcgcagcgagtacgggtttcttctacgtgaacggcacgccgaccgattcggtgcacgtcgcgttgacagggatggccgacgccaggccggacctcgtcgtttccgggatcaacaacggccagaacatgggcgaagacacgctctattcggggacagttgcggccgccaccgaaggcatcatgttcggcgtgccggccattgcgttctcgctggtcgacaagggctgggcccatctcgcggacgccgcgcgcgtcgccgcggagatcgtcgagcactccctcgcgcatccgctgccgggacagccgctgttgaacgtcaatattccgaacctgccttacgacgaactgaaaggctggaaagtcacgcgtctcggcaaacgtcatccgtcgcagccggtgattcgccagaccgacccgcgcggcgaaccgatctactggattggcgcggcgggcgaagcgctggacgccagcgaaggcaccgattttcacgcggtggcaaacggtttcgtatcgatcacgccgctgcagctggacctcacgcatacacagatgctgcccgcgacgcgcgaatgggcgcgcgccggagggcgggcttcatgagcggcgagcgcgcgaagcggttcccgctcgcgctcgaagatctcaagcgagcgccacgcaagtcggaaggtcgggccggcgaacgccatgcggcggtcgcggcatcgaaagccgccgacaagcctgcggccgtgctgaaaccggttgcggtgaaacccgctgtcgcgcgcacggccatgcccggctccccgccgcgaagcccgcgaccgcaccgaagccgaccgcgctgaagcccgcgatgccgaagccggccgcgccgagcgtcgcgccggccggcgcgttcgcgctcacgtcggaacgcgtgcgcgaacggatggtcgaacggctgcgcgcgaacggcgtgaccgacgcgcgcgtgctggaggcgatggccgcggtgccgcgccacctgttcgtggatccggggctggcgacgcaggcctacgaggattccgcgctgccgatcggccaccagcagaccatttcaaagccgtcggttgtcgcgcgcatgatcgagctcgcgatggccggccgcacgctcgagcgcgtgctcgagatcggcacgggctgcggctatcaggccgccgtgctgagccacgtggcacgcgacgtgtattcgattgaacgcatcaagccgctctacgagcgcgcgaagctgaacctgcggccgctgcgtgtgccgaacatccgtctgcactacggcgacgggcgtgtcggcctgccgtccgcggccccgttcgacgcgatcgtgatcgcggcggcggggctcgacgtgccgcaggcgctgctcgagcagctcgcgatcggcgggcgcctcgtcgcgccggtcggcgcgcagagcgggcagcaccaggtgctcacgctcgtcgagcgcgtcgcgcacgcgcaatggcgggagtcacggcttgatcgcgttttctttgtccctttaaaatccggagtaatttgaaaccgatgagtatgttgcgcgcgatgcaaaacaaccgttccagggaaccgctcacgctcgcccagcgcgcgatctgcgtagctgcgttctccacgctactggccgcctgtgcgacgcggctcgacaacgcgcccgtcgtcgatcgctccggttcgctcggcacgactgccgccgcgcagcccgcggtaccgcttccgccggcgccgccgggttactaccgggtaaagccgggcgacacgctgtaccggatcgcactcgaaaacgggcagaactatcgcgacatcgccgcgtggaacaacctggcgaacccgaatcagatcgaagtcgaccagctgttgcgcgtgtcgccgcaggccggtgccgctgtcgcgggcacccaggtcgccgcgccgatcgggggcgccgccgtcgctaccgcgccgctcagcagcggcccggcaacgccggccgccggtacgtcgtcggtcgcgccgccgcccgccgcggcagccgcatcgagcgacacggcagctgcaccgagcggccccgtgacgttcgcgtggccggcgcgcggccccgtgctgaacgggttcgacgacgcgaagaacaagggcgtcaatatcggcggtacggccggcgaggccgtgaaagcggcagccgatggccgcgtcgtctattccggcaatggcctgcgtggctacggtaacctcattatcatcaaacacgatgcaacttacctcacggcgtatgcacacaatcgcgctttgatggtaaagaggggacgcggtaacgaaggggcagaagatcgccgagatgggtaacagcgactccgaccgcgtgatgctgcatttcgaggttcgccggcagggtaagcctgtcgatccgctgaagtatttgccgcctcaataaccgagacgaccatgccgaaatcgaagcgccacgagccgcaagccgagtctgagaagatcagtcgtgccacgcaagcatcggtggggcgagcgggtgcttcgacggacgacgaagacgacaacgcggataacgaacgcgatctcgaggcgcgcgacgccgaggcggacggtggcgacgacgagcgcgaaggccgggccgaggcgtcgcccgacgttgacgatttccgcacgctgctgcaggccgaactcacggccgacacgatccagcattacctgaaccgcatcagcgtgaagccgctgctcaccgtcgaggaggagcagcgctattcgcgtctggccaaggccggtgaattcgaggcgcggcaggtgatgatcgagcgcaacctgcgcctcgtcgtcagcatcgcgaagggatacctgaaccgtggcgtgccgctgctcgacctgatcgaggaaggcaacctcggcctgatgcatgcgatcgaaaaattcgacccgacgcgcggcttccgtttttcgacctacgcgacatggtggatccgccagagcatcgagcgggcgatcatgaaccaggcccgcacggtccgcctgcccgtgcacgtgatccgcgaactgaaccaggtgctgcgcgcgaagcgccacctcgaaaagaattcgatgtcgaccggcgaagcggctgagcgccgcgaagccagcatcgacgacatcgcctatctcaccggcaagaccgccgaggaagtcaccgacatcctcgcgctcaacgagcacacggcgtcgctcgacgcgccgctcgacctcgatcccgcgagcagcctgctcgacctgttgcccgacgaccagagccagtcgcccgacgccgaagtgcagcaccgcgaactcgagacgctcactcgcgcgtggctgtcgcggctgtccgacaagcaccgccatgtgatcgagcgccgcttcggcctgaatcacatcgaaccggcgacgctcgaggagctggccgacgagatggggctcacgcgcgagcgcgtgcgccagatccagcaggaagcgctggtgcgcctcaagcggtttttcgcctccaacggcgtgcgcaaggacgccgttctgtaactgatgactccgattcttgtttttgacatcgagacgattcccgatgtcgacggcattcgccgtctggaagacctgcccgcgacgctcgacgatgccgcggtggccgaacatgcgttcgccgcgcgccgcgagaagaccggtggcgatttcctgccgcaccacctgcagcgcatcgcggcgatctcgtgtgtgttccgtgacaacaacgggtttcgcgtacgctcgctcggcacgccgcaggacaacgaagccacgctgatccagtcgttctaccgcgtgatcgagaaatacacgccgcagctcgtgtcgtggaacggcggtggcttcgatctgccggtgctccattaccgcgcgctcgtgcacggcattcccgcgacccgctactgggatctcggcgaggacgaccgcgaattcaagtggaacaactacatctcgcgctatcactcgcggcataccgacctgatggatgtgctcgcgatgtatcaggcgcgcgcgaacgcgccgctcgacgcactcgcgaagatgtgcggctttccgggcaagctcgggatggatggcagccaggtgtggccggcgttcctggacgggcggatcgaggaaatccgcaactattgcgaaaccgacgtcgtcaatacctacctgctgtattgccggttccagttgatgcgcggcggcctgacgccgagcgagtatgcggacgagatcctgctcgtgaagaactcgcttgcgcaggagccggcgtcgcactgggccgaatacctcgcgggcttcaccgcgtagcgcgggcgggtgcgccgaggccggcgcgatcaatcgagttcgagcagcaccggctggtgatccgatgcgcggacgtcgccgtcgatttcgcagcgcatcacgtgcggcagcagcgtatcggtcacgaatacgaagtcgcacgcgagcggcccctccgaccattgcaccgtatcgtagacgcccgccgtcggtggcggcgtgcggccgggtgccgggcgacccatgcgtcgacgaagcgcggcgcgtctgcgatcggcgccaggaatcgacaataggcatcgctgccgaacgcgctgttgaaatcgccgcagacgatcgcatcgcacggctggccggtcgtgctgaacgggcccgcggcggtttcggcgggcgctggtcgtgccgcgtgtgcgcaggcctcgcggtgccggtcgcgcagcgcgtcgacctgagcgagccgctggcgcgccgaatagtattccagatgcgtggtgaccacgcgcagcggcccgaagggcgcctgcaactcgacgtcgagcgcgacgcgcggcatcgacggcgcaccggcgtcggccggccacggcagcaactggcggagcacgcgcccgaccggcagccgggccgcgatcgcattgccgaactggcgacgcggtgcgccggcttcgatcggcggcaggtcggcaccgatcgcttcgacgatcgtatggccgggcagcagcgccgcgagttcggcgaactggtcggcgccgggccggccgggcaatgcgccgaagccgcgcgtgacctcctgcaggcacagcacgtcgaagtcgccgagcccgcggatcgccgcgacggtgcgcgaaagatcgacgacgccgtccgcgtcccgaccccattggatgttccagtcgatcagtcgcatggtcgaaactcctgccgggcggattccaggcccggggcacccgctcggcttcgcagcgcccgcccgggcgtgttgcgtgcctgggcattccggcgcaatgccgtgcggtctatgctcaagtatggacgcctgcctcatgcaaagcgggcgatgcgggccttcgtcgtctacaatctcgccttcttcaacgtttgtcaggaaaagctggtgtccgaagccgtccccacttctgcgcgcaaatcaagaaatgcgcccgtcgcgcccggaatcgccccggttctcgagatcgaatcgctcgacatggaagcgcgcggtgtcggccgcacgattaccgaggacggcgagccgggcaaggtcatcttcgtcgagggcgcgctgccgggtgagcgcgtgacctattcgagcttccgccgcaagccgagctacgagcaggcgacggttgtcgacattctgcgcccgagcgtgatgcgcacgaagccgaaatgcgcgttcttcggcacctgcggtggctgctcgatgcagcatctcgacatgcgcgcacaggtagcggtcaagcagcgcgtgctcgaagacaacctgtggcacctggcgaagctgcgcgcggaaacgatgttcgcgccgatccacggtccgtcgtggggctatcgctaccgcgcacgcctgaccgtgcgcaacgttgcgaagaagggcggcgtgctggtcggattccatgagaagaagagcagctacgttgccgacatgacgagctgcgaagtgctgccgccgcacgtgtcggcgatgctggtgccgctgcgccggctcgtcgagggctgtcgattcgcgatcggatgccgcagatcgagctcgcggtcggctcggaagtcacggcgctcgtgctgcgtgtgctggaaccgatcaacacggacgacgaagcgctgctgcgcgcgttcgcggacgagcacaaggtgcagttctggctgcagccgaagggccccgatacggtgacgccgttctatccgctcgacgtgtcgctcgattacacgctgccggaattcggtatccgcatgccgttcaagccgaccgacttcacgcaggtcaatcatcagatcaaccgcgtgctggtgggccgcgcgctgcgcctgctcgcgccgtcgcgcgacgaccgcgtgctcgacctgttctgcgggatcggcaacttcacgctgccgctcgcgcggctgtcgcgcgaggtgatgggcatcgagggcagcgatacgctgacgacgcgcgcactggcgaatgcgcgcgaaaacggtgtcgacggtcacacgacgttcgcgtgccggaacctgttcgaagtgacgggtgacgacatccgtgcgctcggcgcattcgacaagttcctgatcgacccgccgcgcgaaggcgcgctcgcggtatcgaaggcgctggccgagatcgcgcagagcggtgaaggcccgctgccgaagcgcatcgtctatgtgtcgtgcaacccttcgacgctggcgcgcgacgcgggcctgctcgtgcacgaggccggctaccgcctgaagggcgccggtgtcgtgaacatgttcccgaatacgtcgcacgtcgaatcgatcgcactgttcgagcgcgactgagttccgggcggcagacgtaaaaaccggcccgcgggccggtttttcatgatgcgtggcgaacgtcagttgcggttgccgccgaagatgccgagcagcgcgagcaggttcgtgaacacgttgtacaggtcgaggtagatcgcgagcgtcgccgagatgtagttcgtctcgccgccgttcacgacgcgctggacgtcgaacagcatgtaggcggagaagatcgcgatcgcgagtaccgacacggtgagcatcagcgccgggagttgcaggaagatgttcgcgaccgatgcaagcaggatgacgatcacgcccatgaacagccacttgccgagccccgagaaatcacgcttgctgacggtggcgatcgtcgccatcgcggcaaagatgatgccggtgccgccgaacgcaagcatgatcagcgacgggccgttcgagaagccgaggatgaagctcagcagccgcgacagcatcaggcccatgaagaacgtgaagccgagcagcacgaacacgccggccgcgctgtttttcgtccgctcgatcgcgaacatgaagccgaacgcgatcgcgaagaacgcgagcaggctcatcatcgggctcgtggccgcgaacagcgagaagcccgtcgcgacgccgacccaggcgcccagcacggtcggcaccatcgacagcgcgagcagccagtacgtgttccgcagcacgcggttgcgaacctcggcggtgctgacggaaccgccgcggccgaaattgtacggatagtcgttcatggtttctcctaacattgaacgcgtgggcgtccggggccggttcggcgcgcgcggtgtgcggcgcagcaaaccggagcagctatggctaagatacgttccgtgccgggaggtttcaatggccgggcggcacaaaacatatggattctgaacctttcatgcgtgtaagggttcaatcgcaatgatacacgggatcgtgctacaatagcggattcatttgaacctgtaacttcttaatttcttggagtttttatggcaatcgagcgcaccctgtcgatcatcaagccggatgcggtggcaaagaacgtgatcggccagatctacagccgtttcgaaggcgccggcctgaagatcgtcgcatcgcgcatggcacatctgtcgcgtgctgacgcagagaagttctacgcggttcacgcagcgcgtccgttcttcaaggacctcgtcgatttcatgatctcgggcccggtgatgatccaggttctggaaggtgaaggcgcgatcctgaagaaccgcgacctgatgggcgcaacggatccgaagaaggcggaaaagggcacgatccgcgccgacttcgcagacagcatcgacgcgaacgccgtgcacggctcggacgctgcggaaacggcagcggtcgaagtcgcgttcttcttcccggaaatgaacgtttactcgcgctaagccctggctggcagcaagtaggcaggattcagcgcacgcggcaaggcagcacatcatgacgagcgaaacttccgtcaatcttctcgacttcgatgccgagggtcttgtcgcgtactgcggcagcctcggtgagaagccgttccgcgccaagcagttgcagcgctggatccaccagtacaacgctggcgatttcgacggcatgaccgatcttgcgaagtccttgagagagaaactcaagggccgcgcgtcgatcgtcatgcccgagatcgccagcgatcacgtttccaccgacggcacgcgcaagtggctgatcgacgtcggaaacggcaatgcggtcgaaaccgtgttcatcccggaagagacgcgcggcacgctgtgcgtgtcgtcgcaggccgggtgtgcggtgaactgccgcttctgttcgacgggcaagcagggcttttcccgcaacctgtcgacagccgaaatcatcggccagctacggatggctgaatttgcattgcgagcgtcgctgggtcgcgcacccggcccgaatggcaaggccgagcgggtcgtcaccaacgtggtgatgatgggcatgggcgagccgctgctgaattacagcgcggtcgtgccggccatgcggctgatgctcgacgacaacgcgtacggcctgtcgcgccgccgcgtcacgctgtccacgtctggcgtggtgccgatgatggaccgcctcggcgccgagttgccggtcgcgctggccgtttcgctgcacgcgcccaacgatgcgctgcgcgacgagctggtgccgctcaacaagaagtatccgctgcgcgagctgatggcggcttgccagcgctacctggcgtcgcgccgcgcgacttcattactttcgaatactgcatgctggacggcgtcaacgacaccgaagcgcatgcacgcgaactgctggccgtcacgcgcgacgtgccgtgcaagttcaatctgatcccgttcaatccgtttccggaatcgggcctcatccgctcgaaaccggagcagatcaagcgctttgcacaggtcctcatcgacgcgggtgtcgtcacgaccgtgcgcaagacgcgcggcgatgacatcgatgccgcgtgcggccagctggccggcgcagtgaaggatcgcacgcgcctcgcggaacgaacgggcgcagcagggaaaatcatcgaggttcgggcgatttgacaggggcgcctggccggggatgccagcgcttttggggcggtacaacacgcgaatagcgatcggtcgcggcgccacggcgtcgcgcatggtatggacagttgcgggtgccggccggcgggaaccggcggcggccgccagtgaagaagaatcgacgcgaggacaaggatgagtgagccgcagccgtctaacggcgcagagacgaatggcgcgaagccggcaccggcagggttggaatcgcttgcggcggtcggcagccgactggcgcagcttcgggaggcaagaggatggaccgtcgacgacgtgtcggcgcgactcaaggtcgcaccgcagaagctccgggcgctcgaggcgggtgacatcagtcatttgcccggcgtgacgtttgcactcggcgtcgtacgcagctacgcgaagatgctcggcgtcgatccggaaccgttcgcgcaggcgttgcgccgtgagcgcggggtgccggaagtcgacctgtcgatgcccgcgtcgtcggggacggatctgccgcgcggccgcgtgtcgattccgctgggcggatcgtcgcggcatcatccgtggctgtggggcacggcgatcgtcgtcgtcgcggtggtcgccgtactgatgtggcacactggcggcgattcgtcgagcctgctcgcgcgtttcaagagcggcgacgcggagcatgcgtcggccgcgagcgtgccggcggcggcatcttcgtcaaccgtcgaggaggcggcctcgagcggggcggctgccgtggtcgcgaatgaggttccggccccgactgctgcatctgccgcgccggcaccggttattgcgccggcagcgcccgcgccggtggcgccggccgtgacggccgccgcatcgcagcctgtcgtggcgacgacggcggcaagcgctgccgcgccggctcagccggcgagcgtcgcggtcgcggccggccagtcgatggtcgaactgaaggtcaagcaggacagctggttcagcgtgcgcgacaagagcggcaaggagctgttctccgggctggtacgcggcggcgaggcgaagcaggtcgcgggcgagggcccgttcaaggtcacgatcggcaacaaggcgggcctcgacaccgttgcgttcgacggaaaacccgtcgatccggcaaaatattcggcagcgcggggtaacgtggcgcggttcacgttgccctgacgtcaagcgccgtggcgaaggcctgtcgtcgatatcggcaggccgtgagggcacggcgctttttcaattcatgcgccgcgtcgcggcgcattccgcgtaaatggatctatcgatgcaatccgaagctcaatccccacgcagcagtcagatttgttcaaccgagccggtgttcggcgggcatcagccgcgccgcgtatcgcatgcggtggatgtccgctggggcgggcagctcgtgacgatcggcggcgacgcgccggtgcgcgtgcagtcgatgacgaataccgacacggccgacgcgatcggcacggcaatccagatcaaggaactcgcgaacgcaggctccgaactggtgcgcatcacggtcaacacgcccgaggccgcggccgccgtgccggcgatccgcgagcagctcgaccgcatgggcgtgaccgtgccgcttgtcggcgatttccactacaacggccacctgctgctgcgtgactacccgggctgcgccgagtcgctgtcgaagtaccggatcaacccgggcaacgtcggccagggcgcgaagcgcgatacgcagttcgcgcagatgatcgaggccgcggccaagtacgacaagccggtacggatcggcgtgaactggggcagtctcgaccaggatctgctcgcgcgcatgatggacgagaacggtgcgcgttcgcagccgtgggatgcgcagagcgtgatgtacgaggcgctgatccagtcggcgatcggctcggccgagcgcgcggtcgaactgggcctcggccgcgaccgtatcgtgctgtcgtgcaaggtcagcggcgtgcaggacctgattgccgtgtaccgcgaactcggccgccgctgcggcttcgcgctgcacctcgggctgaccgaggccggcatgggctcgaagggcatcgtggcttcgacggctgcactcggcgtgctgttgcaggaagggatcggcgacacgatccgcatctcgctgacgccggagccgggcgcatcgcgcacgggcgaggtgatcgtcggccaggaaatcctccagacgatgggcctgcgctcgttcgcaccgatggtgatcgcgtgcccgggctgcggccgtacgacgagcacgctgttccaggagctcgcgatgcagatccagacctacctgcgcgaacagatgccggtctggcgcaaggagtatccgggcgtcgagaagatgaacgtcgcggtgatgggttgcatcgtcaacggcccgggcgaatcgaagcacgcaaacatcggcatcagcctgccgggttcgggcgagaacccggccgcgcccgtcttcatcgacggcgagaaggtcaagacgctgcgcggcgagcggatcgccgaggaattccagcagatcgtcagcgactacgtcgcacgcaattacggccgtaccgaggccctgaactaattcgtccacacacacgatgactgaacaaaaacgcaagatcgagaagctcaccggcgtcaagggcatgaacgacatcctcccgcaggatgccggcctttgggagttcttcgaagccaccgtgaaatcgctgctgcgtgcatacggctaccagaacatccgcacgccgatcgtcgagcacacgcagctcttcacgcgcggtatcggcgaggtcacggacatcgtcgagaaggagatgtacagcttcaccgacgcgctgaacggcgagaacctgacgatgcgcccggaaaataccgcggccgtggtgcgtgcgtcgatcgagcacaacatgctgtacgacggcccgaagcgcctgtggtacatcggcccgatgttccgtcacgagcgtccgcagcgcggccgctatcgccagttccaccaggtcggcgtcgaggcgctcggcttcgcgggccccgatgcggatgccgagatcatcatgatgtgccagcgcctgtgggatgacctcggcctgaccggcatcaagctcgagatcaactcgctcggcctcgccgaagagcgtgccgcgcaccgcgtcgaactgatcaagtacctcgagcagttcgccgacgtgctcgacgaggatgcgaagcgccgtctgagtacgaacccgctgcgcgtgctcgacacgaagaatcccgcgctgcaggaaatcgcgcagaacgcgccgaagctgatcgacttcctcggcgaagaatcgcgcgcacacttcgaagggctgcagcgcctgctgctcgcgaacaacatcccgttcaagatcaacccgcgtctcgtgcgtggtctcgactattacaacctgaccgtgttcgagtgggtgaccgacaagctcggcgcgcagggcacggtcgcggccggcggccgctacgatccgctgatcgagcagctcggcggcaagccgaccgcggcgtgcggctgggcgatgggcatcgagcggatcctcgaactgctgaaggaagaagatcttgcgcccgagcaggaaggcgtcgacgtgtacgtcgtgcaccagggcgagactgcgcgcgaacaggcgttcatcgcggccgagcgcctgcgcgatacgggcctcgacgtgatcttccactgcagcgcggacggcgcgccggcgagcttcaagtcgcaaatgaaacgggccgacgccagtggcgccgcgttcgcggtgatcttcggcgaagaggaggtcgcgaacggtacggtgggcgtgaaggcgctgcgcggtgcgggcggagacggggaaaagaacgttcagcagaccgtaccggtcgaaggcttgaccgaattcctaatcaatgcgatggttgcatccgccgaagacggcgacgactgatcgcgctggcatccgctcgacaagaaaggcctgaacaggaaggaatcgctcgccgatgagttatcacgacgaacaagaatcgattgaaagtctgaaggcgtggtgggcccgctggggcaacctcaccacgtggatcgtgctcgcggcgctcgtcgtcgcggccggtttcaatggctggaactactggcagcgccgtcaggctgccgaggcgtccgggctgtacgaacaggtccagaaggctgccgccgcgaacgacaaggcgacgatggctcgcgcggccgccgacatggaagacaagttcggcagcacgccgtatgcacagatgacggcgctttccgccgcgaagacgctgtacgcggccggtgacacggcaggtgcgaaggcgcaactgcaatgggccgtcgatcacgccaaggatgacgagtacaagcagatcgcgaagctgcgcctcgcgtcgctgctgctcgacgagaaggcgtacgacgcgggcctcgcgctgctgtcgggtacgccggtcgatgcattcaagggcctcgtggccgatcgccgcggcgatctgcttgccgcgcaaggcaagaccgacgacgcgcgcgccgcatacaagctcgcgctcgacggcctgtcgaaggacgaccagtctgcccgccagctcgtgcagttcaagctggacgcgctcggcggctgaaccccggtcccctcaacctcttaactctgcttcgctaaccgatgaatttgctgaaacgttacgctgtgcccgttgcctgcgcggcggctgtcctcgcattggcggcctgctcgtcgtcgaaggacgcgcgccgcgtgccgacgccgctcaccgagttcaagcccgtgatggacgtgcaacaggtctggaaggcgagcgtcggcaagggcgggcgttacctgttctcgccggtggccgtgggcgacgccgtctatgcggcgggcgaaaacggttcggtcgagaagatcgacgcgaagacgggccagacggtctggcgcgcgaaggttggctccgacctgtcggccggtgtcggcagcgacggcaacctgaccgcggtcggcgcgctgaagggcggtgtgttcgtgctgggcccggacggcaagcaactgtggaagaccagcgtgcagggcgagatcttctcgccgccgctcgtcggcaacggcctggtggtcgtccgcacgatcgacggccaggtggtcgcgttcaacgcgcagacgggcgagcagaagtggaactaccgcaaccgcgcggtgccgctgaacctgcgtgtgtcggccggcatgacgttcgccggtgacgcggcggtgctggcgggtttcccggcggcgggctggtcgcgatcaacctgcagacgggcgagccgttctggcagacgccggtgtcgttcccgaagggcgtgaccgaggtcgagcgcatcaacgacgtcagcggcccgccgacgctcgtgggcgcggaagcctgcgcggtgacgttccagggtcagctcggctgcttcgatgcgaactcggggcgcccgctgtgggaaaagccgttctcgagccgcagcggcctcgcgcaggacgactcggtcgttgccggcggcgacgactggtcggtcgtgactgcgtacgatgccgcttcgggcaaccagctctggcgcaacgacaagctgaagagccgcgacgtcggcgtgccgtacctgctcgggcacgcggtcgtgatgggcgattacaagggcttcgtgcacttcctgtcgcgcgaagacggcagcttcatcgcgcggatgaagaccgacggcagcgcgatcacggcggcgccggtcctcgcgggcaatacgctcgtcgtgcagacgaaggacggcggcctgtacggattccgtccgcgctgacgcgcaggaaacatgcgcgaccgcggcgcgacgggcttgtcccgcgcgccgtggtcgcgcgatttgaaggcggccggtgctcccggccgctcggtatttgaaaggcagttcgagacgaaagacgacggcgcgcatcgcgcgccaggcgcgcgcatccggcgcggcgcgaattcgtgatattttcattcagcgcagccgcccgcagcagcgggcctcccgctgctgcgcttcaccgtagaaaacacagatgaaaccggtcattgccctcgttgggcgccccaatgtggggaaatccacgctgttcaaccggctcacgcgttcgcgtgatgcgctggtcgccgacttgcccggcctgacgcgcgatcgccattacggcgaagggcgcgtcggcgagcggccgtacctggtcgtcgatacgggcggcttcgagcccgtcgcgaaggacggcatcctgcacgagatggcgcgccagacgcgccaggccgtcgaggaagccgacgtcgtcgtgttcatcgtcgacggccgcaacgggctcgcgccgcaggacaagtcgatcgccgactacctgcgcaagaccggccggccgatcttcctggtcgtcaacaaggccgaggggatgaagtacacggcggtcgcgaccgacttctacgagctcgggctcggcgatccgcgcgcgatctcggccgcgcacggcgacggcgtgaccgacatgatcaacgaggcgctggaggtcgcgtacgcggaccggccggcggaagaggacgacaacgatccgtcgcgcggcatcaagatcgcgatcgtcggccgcccgaacgtcggcaagtcgacgctcgtcaacgcgctgatcggcgaggatcgcgtgatcgcgttcgacatgccgggcacgacgcgcgattcgatctacgtcgacttcgagcgtaacggcaagaaatacacgctgatcgacacggccggcctgcgacgccgcggcaaggtgttcgaggcgatcgagaagttctcggtcgtgaagaccctgcaatcgatctccgacgcgaacgtcgtcattcttctgctggatgcacagcaggacatttccgaccaggacgcgcacatcgccggcttcgtcgtcgaacagggtcgcgcgctcgtgatcggcgtcaacaagtgggacgggctcgacgagcatgcgcgcgatcgggcgaaagcggatttgacccgcaagctgaaattcctcgacttcgcgaaatcgcacttcatttctgccacgaagaagaccggcatcggcacgctgatgcgctcggtcgacgacgcgtacgcggcggcaatggcgaagctgccgacgccgaagctcacgcgcgcgctgatcgaggcagtcgagttccagcagccgcgccgtcgcggcccggtgcgtccgaagctgcgctacgcgcaccagggcggccagaatccgccgatcatcgtcatccacggcaacgcgctcgacgccgtgacggaaacgtacaagcgttacctggaaaaccggttccgcgaaactttctcactgacagggactccattgcgcatagagttccgttcgtcgaacaatccgtacgcggacaagagctgaagcacgcctgttacacgcgttacacaaggggtaggccgcacggcctatgccccgggtgggccaggcaaaatcggctatagtgtagcgattggcgccggatctctttttcttcgccgccaatccagatcaacctgcaaaaaagatggagtacgccatgagcaacaaagggcaattgttacaagacccgtttttgaacgcactgcgcaaagagcacgttcccgtttcgatctacctcgtcaatggcatcaagcttcaagggaacattgaatcgttcgaccagtacgtcgtgttgctccgtaatacggtgacccagatggtgtacaagcacgccatctcgacggtcgtgccggcgcgcccggtgaatttccacccggacgcggaagcctcgtcctaacctatcgcagcggccggcatccggtcgccgcgagcgaccgatgccagccgccttatcttgacacctgaaaatttgatcaacgcagcgctcgtcggcatcgatttcggcaagaccgatttcgaagccagtctcgaagaactcagtcttctcgcctccagtgcggggcccgtcccgccgtcaccctcacgggtcgtcgctccagtcccgatgccaagatgttcatcggcagcggcaaagccgaagaactccggctcgcctgcgacgcgcacaacgtcgaaatcgtcatcttcaatcacgcattggcgccggcccagcaacgtaatctggagcaggcacttaacaggcgtgtggtcgatcgcaccagcctcatcctcgacatcttcgcgcagcgcgcccgtagccacgaaggcaagctgcaggtcgagctcgcgcagctccagtacctgtcgacgcgactcattcgcgcgtggacccacctcgaacggcagaagggtggtatcggcctgcgcggccctggcgaaacccagctcgaaaccgaccgccggctgatcggcgagcgcatcaagatgctgaagtcgcggctggaccggctgcgccggcaacacagcacgcaacgccggcaacgcgcgcgcagcggcacgatgtcggtgtcgctggtcggctatacgaacgcgggcaagtcgacgctgttcaatgcgctgacgaaagcgcaggcctatgcggccgaccagctgttcgccacgctcgacaccacgtcgcggcgcgtgtatctcggcgacgaggtcggccagatcgtcgtgtcggatacggtcgggttcatccgcgagttgcctcaccaactggtcgccgcattccgcgcgaccctcgaggaaacgattcacgcggatctgctgctgcacgtggtcgatgcatcgagcgcggtcaggctcgagcagatcgagcaggtcaacggcgtgctgcacgagatcggcgcggacacgatccggcaggtactggtgttcaacaagatcgacgccgtgcctgagctggcggcccgcggcgacgcggtcgagcgggacgagtatggtaatatttcgcgcgtctttttgagcgcgcgcaccggtcagggtctcgatacgttgcgtgccgccatcgccgaaatcgcctccgcggaacacctttccagcgcgacgttgtccgacgcgctcgatagcacgtccgctgaaccacacgaagaccacacgatttccgaacacgggcgctaaccggtcccggccggttcgccggcgtctaatctggtgaacaaactctggtgaacgaatacaacgagcggagtacctggcggcggatgcgcgccttgctgtcgatcaacgatccccgctggggacgcggcgaaggcaatggcaaagacggatcccgtccccgtgcgaacgaatcgaagcgtccgcaaggcggcgacggcgatggtccgcccgatctcgacgagatgtggcgcaacttcaaccggcgcctgaacggccttttcggcggcaagggcggcaacggttttcgtcctgacaacgggcgtgccgcgcgagtcggcgtaggcatcgtgatcggcgtgctggtcgcggtctacgcgggcagcgggctgttcgtcgtgcaggaaggccagacaggcgtcgtgctgcagctcggcaaactgtcgggtacggtcggtcagggcgtgcactggcgcgcgccgtatccgttcgcgtcgcacgagatcgtcgacacgtcgcaggtccgctcgatcgagatcggccgcaacaacgtcgtgcgcctcgcgaacgtgaaggaagccgcgatgctgacgcgcgatgccgatatcgtcgacgtgcgcttcatcgtccagtaccggatccgttccgcgaccgattacctgttccgcagcgtcgatcctgagcgcagcgtgtcgcaggccgcgcaggccgcggtgcgtgcgatcgtcggtacgcgcagcgcggccgatgtgctgaaccaagaccgcgacgcgctgcgcgagcagctttccaccacgatccagcgcgatctcgatcgctaccagtcgggactcgaggtgacggccgtcacgatgcagagcgttgcggcgcccgagcagacgcaggccgcgtacggcgaagtcgccaaggcgcgcgacgagcgcgaggccgcgaagcgcgccgcgcaggcgtatgcaaacgacctgctgccgaaggcgcagggcgatgccgcgaagctcgtcgacgaagcaaaggcgtatgccgatcgcgtggtcacggaagccgaaggcgatgccgaccgcttcaagcaggtctatgcgcagtactcgaaggcgcctgcggtgatccgtgagcggatgtatctcgagacgatgcaggaaatctattcgaactcgacgaaggtgttcgtcggcaacaagggtggcaacagcgtcgtgtacctgccgctcgacaagctcgtcgagcaggggcgacaaaacgccgcggcgtccacgggggcatccgcacccgatgcggcgtcggcaccggtggccgtcgcgccggcggtagcggcgcccgcgagtgcggcgtcggccgcggcagcgtcgggcaacgacgtgctgcgatcgcgcgaggcgtttcgcagccggtcgcgcgaagacgatctgaagtaacggagagcgcagaacatgaaccgaatcattgcgctcgtcgtcgcaatcgtgatcgttgccttcgcggcatcctcgacagtccttaccgtcgatccgcgccatgcggccgtgctgtcgggcgcgacggcgcgcagcccgaactggcggggcccggcatccatttcaaattgccgccgccgctgcagacggcgacgctgatcgacacgcggctgcaatcgctcgagtcgtcggatccgctgcaactggcgacggaagacaagcacgatctgctcgtcgcctatgcggtgaagtaccggatcggcgatccgatgaagtatttcacggcgacgggggcgacccggcggcagccagcgaacgtctggccggcgcactgaagggcgcactcggcgacgcgttcggcaagcgtgcgctcgacgatgcgctcggcggccagcgtgcgatcgccgatgcggcccgcgacgaagtgaaggcaaaggcgtccggtttcggcgtcgatgtggtcgacgtccagctgacgcgcgtcgacttgcccgccgcgcaaaccgatgcggtctatcagcggatgatcggcgcactgcgcgatcaggccgcgcaggtgcgtgcgcaaggcgcggccgacgtcgagcagatcaaggccgacgccgaacgcgatcagcaggccgtgctcgcgaacgcgtacaagtccgcgcagacgatcaagggcgagggcgacgcgaaggccgcgacgatcgccgccgatgcgttcggccgcgatccgcagttctatcagttctacgcgagcctgcaggcttaccggaacacgttcaagcgcaacgacatcatcgtcgtcgatcccgacagcgagttcttccgcttcatgcgcagcccgacgggcggtgccgcaccggcggcggctgctcccgcaaacactgaccttggggcgccgcgtcgagcggcgccgtcgctcgcatggacctggctggctcgttgttgctcgcagtagcgctgatgctgatcatcgaggggcgttcccttcgtgtttcccgtcgcctggcgcgacacgtttcgtagaatagctgagcggccgccgcatcatatccggatcggcgggctgatcgtgatggtgctcgggctcatactgttgctgctcgccacctgatccggacggcgcatccgccgtccgtcccgcccgaattcagaatttccgattcacatcgcggcgcgcgtggtcgcgcgctgtttcccgtcgtaggaccgtaccgatgtcgacctggttacttcccgagaatatcgccgacgtgctgccgtcggaagcgcgcaagatcgaggagctgcgccgcaggctgctcgaccgcttccgttcgtatggctacgaaatggtgatgccgccgctgctcgagtatctcgagtcgctgctgacgagcggcggcgctgacctgcgcctgcgcaccttcaagctggtcgaccagctgtcgggccgtacgctcggcctgcgcgcggacatcacgccgcaggtcgcgcggatcgacgcgcacctgttgaaccgccagggcgtgacgcgcctttgctatgcgggccacgtgatgcatacgcgtccgcgcggcctgcacgcgacgcgcgagcagatccagatcggcgccgaaatctacgggcatgccgggctggaagccgacctcgagatccagcaactcatgctcgatgcgctgcatctcgcaggcctgtcgcgcattcgtctcgacctcggccacgcgggcgtgctcgcggcgctgctggcgcgcgacgcgcaggccgcggagcgtggcgagtcgctgtacgacgcgctgtcgggcaaggacgtgccgctgctgaacgaactgaccgacgatctcggcgccgatacgcgcgccgcgctgcgcgcgctgccgcacctctatggcgacgcgagcgtgctcgccgaggcgcggacgcggttgccggtgctgcccgaaatcacgcgggcgctcgacgatctggcgcaactcgcggcgcaggcgaagggtgccgaagtggcgatcgatctgggcgatctgcgcggctacgcgtatcacagcggcgcgatgttcagcgcctacatcgacggcgtgccgaacgcgatcgcacgcggcggccgctacgaccacgtcggccaggcgtatggtcgcgcgcgtccggccaccggcttctcgctcgacctgcgcgagctcgcccggatttcgccggtcgaggctcgcgggaccgcgattctcgcgccgtgggcgcaggacgacgcgctgagcgcggccgtttcggcgctgcgcgatgcgggcgaggtcgtgatccaggcgctgccgggccacgatcacgtgctcgacgagttcgcctgcgaccgttcgctcgtcgagcgcgatggcgcatgggtggtcgaaccccgataaagaggcgttcgcgggacgtgcttcggcgtgcatatcgttgaagcgaaacggaaaaattcggaatcgcccgcgaacataggtagaatacgtttttaaccagctaacgaatcaacatgtctgccagcgcagtgaacgtgactcccgggcgcaatgtcgtcgtcgtgggaacgcaatggggtgatgaaggcaagggcaagatcgtcgactggctgacggaccacgctcagggcgtcgtgcgtttccagggcggtcacaacgccggccacaccctcatcatcggcggcaagaaaacgatcttgcgcctcattccgtcgggcatcatgcgtgaaggcgtcgcctgctacatcggcaacggcgtcgtcctgtcccctgaagcactgttcaaggaaatcggcgagctggaagaggccggcgtgaacgtgcgcgaccgcctgttcatttccgaagcgacgacgctgatcctgccgtaccacatcgcgatcgaccaggcgcgcgaagcgcgcaagggcgcgggcaagatcggcacgacgggtcgcggcatcggccccgcgtacgaagacaaggtcggccgccgcgctgcgcgtgcaggacctgttcgacgcgaagaccttcgccgaccgcctgcgcgaaaacctcgatttccacaacttcgtgctgacccagtacctgggcggcgcggccgtcgatttccaggcgacgctcgacacgatgctcggttatgccgaccgcctgaagccgatggtggccgacgtgtcgcgccgcctgtacgacgcgaacaatgcgggccagaacctgctgttcgaaggcgcacaaggcacgctgctcgacatcgatcacggcacctatccgttcgtcacgtcgagcaactgcgtcgcaggcgcggcgtcggccggcgcgggcgtgggcccgcagaagctcaactacatcctcggcatcacgaaggcgtattgcacgcgcgtcggctcgggcccgttcccgagcgaactgtacgatgcggacaacccgcagcgtcaggaccaggtcggcgtcacgctcgcgaacgtcggcaaggaattcggttcggtcaccggccgtccgcgccgcacgggctggctcgacgcggccgcgctgcgccgctcgatccagatcaacggcgtgtcgggcctgtgcatgacgaagctcgacgtgctcgacggcctcgacgaagtcaagctgtgcgtcggctacaagatcgacggcaaggatgcggacatcctgccgcgcggtgccgccgacgtggcacgttgcgagcccgatacgaaacgtttgccggctggaaggaaagcacggtcggcatcaagacgtgggaagcgctgccggcgaacgcccaggcttacctgacccgcgtccaggaagtggccggtgtgccggtcgacatggtatcgacgggcccggaccgcgacgaaacgatcctgctccgccatccgttcaaggtgtaaccccagatgacgcagcaaatcacgatgacggcggcagacttgatgaccgatccgcgcaacgacgacaagaacctgtgggtaggctgggacgagtatcaccgtctcatcgagttgctcgccctccaggtacatgcatcgggctggaagttcgaccagatcctgtgcctcgcgcgcggtggcctgcgcgtcggcgatcaactgtcgcgcatctacgacgtgccgctcgcgatcctcgcgacgagttcgtaccgggaagcggccggcacggagcagggcgagctcgacatcgcgcagtacatcacgatgacgcgcggcaatctggcgggcaacgtgctgctggtcgacgatctcgtggattcgggcgtcacgcttgcgcgcgtgcaggagcacctgaaggagcgctacccgtccgtgacggccgtgcgttctgccgtgctctggtacaagggctgctcgaaggtcaagcccgactatcacacgcagtatctgccgacgaatccgtggattcatcagccgttcgaggaatgggatacggttcgcccgcacaacctcgaggcgtggatcaagcgcggtcgcgcacagcgcgacggttcgggcgcgtaagcggccggccaatcgaaggaaagccttgtacggcgccgcttgcggcgccgtttttcattggggcgccatgcacgccggcggcgcgcgggccgcggatccggtaggcagacggcgctgccccggctatgattggcagccctgccacagcttgcgccggattgcatgcatggcgtggctcacgtggttccaaggcaacagagcagggcggcgtttcaaggggcgcgagtagaatagcgctcgttttgtccgacccggacccgattattacgcttcatatgaacgacacgatccacgcgaccgacgcagcacacgcgccgcattcgacgcagcaacactcgatgcgggcgctagcgatagcagccatcggcgtcgtgttcggcgacatcggcaccagcccgctgtattcgctcaaggaggcgttcagccccgcacacggtatcccgctcaccgaaggatcgattctcggtgtgatctcgctgctgttctgggcaatcatcctggtggtcggcatcaagtacctgctgttcgtgatgcgggcggacaacaacggcgaaggcggcgtgctcgcgctgatggcgctgtcgttgcggccgctcgactcgaagacccgcgtcgcgggcgcgctgatggcgctcgggattttcggcgcatgcatgttctacggggacgcggtgatcacgccggcgatctcggtgatgtcggcggtcgaaggtctcgagatcgcgacgccgcacctgtcccatctcgtgatgccgatcacgatcgtgatcctgatcgcgctgttctggatccagcgccacggcaccgcgctggtcggcaagctgttcggcccgatcatggtgctttggttcgtcgtgatcgcggcgctcggcgtgtaccacatcgtgcgcgtgccgggcatcatcgcggcaatcaacccgtattacgccgcgtcgttcatgtcggagcatgtgctgcaggcctatgtcgtgctcggctcggtcgtgctggtgctgaccggtgcggaagcgctttacgcggacatgggccacttcggcgcgaagccgatccgcatcgccgcgtacgggctcgtgatgccgtcgctcgtgctgaactacttcggccaggcgcgctgctgatccagaacccgaaggcgatcgagaacccgttcttcctgctggccccgaatggggctgctgccgctcgtcgtgctgtcgacggtcgcgaccgtgatcgcgtcgcaggcggtgatctcgggcgcgtattcgctgacgtcgcaggccatccagctcggctacgtgccgcgcatgaaagtgctgcatacgtccgatctcgcgatcggccagatctacgtgccggtcgtgaactggctgctgctgttcgtgatcctctgcatcgtcatcggcttcaagagctccgacaacctcgcggccgcgtacggcatcgcggtgacggcgacgatggtgatcacgaccgtgctcgccgcggtcgtgatggtgaaggtgtggaactggaaccggctgctggtcggcgcgatcatcgccgtgttcctcgcggtcgacctcggatttttcggcgcgaacctgctgaaggttgcgcagggcggctggctgccgctcggcatcggcgcgttgctgttcttcctgctgatgacctggtacaaggggcgtcacatcgtcaaggagcgcacggccgccgacggtattccgctcgagccgttcctgcagggcctgctcgcgcatccgccgcatcgtgtgtcgggtaccgcgatctacctgaccggcaacgacaagctcgtgcccgtcagcctgctgcacaacctgaagcacaacaaggtgctgcatgagcggaccattttcctcacgttcgtgacgcgcgattttccctacgtgcgcgacgacaagcgccagaccgcgcgtgatgcgggcggcgggctgtatatcgtcaaggccgagtacggcttcaacgagacgccggacgtgaaggccgtgctcgaggaattcggccgcacgcacgacatgacgttcgagctgatggacacgtcgttcttcctcgcgcgcgaaacggtcgtgccgacgcatctgcccgggatgtcgatctggcgcgagcgcgtgttcgcgtggatgcaccagaatgccgcgaagccgaccgacttcttctcgatcccggcgaaccgcgtggtcgagctcgggacgaagatcgagatctgaccgggggcggcgcgcgggtcgttcagccgcgcgccgccgagtccgccgaccaggcaatcaggccgcgatcgtccgcatcgccggccgcagccgcagccgtatagcgctgcgtatcccgcgcgacccagtccagataaccgcgaatccagtatcggcagccgtcgacaaggccgcgcacgcgcgtgtcggcatgctgggcgagtgcatcggcgcacaggacgaatgcgctgatctcggcgcgcacacgctcggctgtgtagtcgatgctggcctgcagcgtatggccgcgggaagcgtggatcatcaccatgttccggaactgcccgggctggtccgcttcgacgccgacgctctggatgtcgttgctccagcagacgatatggttcgcgtgccggaacagcgtctggatttccggccgatgaaacgtatcgggcgggacggcaccggcattggccgcgtccgccagcgcgaggcaaggattcatcccgctcgtgtgacgccggatcgtttcgtattgctgcactgcgatcggctcggccctcaggtggccgataatctgcagtccggccgtggtggcccacaggcgcatgccttgtgcgaagcgcgcgaaatgttcggccgacaggcgggcgcgcaggcgctggcacacatcgagccatgctcgctcgccatatatgggctgggggccggtacattcgtagtcgagcacatcgatcatcgcggtcagattgcgcaacgtatcggggccgaccggctcgacgcgatcgacgaacaggtcgtcgacgagaaagaaccacacgaaataatcggcgagcgcctgcagcagggaaggatcggcgttcgggtaacagcgcgcggcgagccagccgtatcgggtgcgtacgacgcgttcccggtaggcgtcgctgatgaacaggccgtatgcgtcggcccactcgagcatgcgcgattcgattcgctcgacgtgcggtgaacaggcgccggcccacggcacgtcgaaaacgggcatgtgcaatgcggccagttcggttttcagatggtcgtctgtcatggttccccgatccatttttcgcgaatccgtcccggttcgccggtcaggcgaataccggatgcaatgcgtcgcgaatcgactgcaaaaaggcgagaccgaaacacgggaggcaggatattcaccgtgcatgcgagcgccgcggagaacgctgccgctgaacggcaagatcgctgcccaatacagaagcatcaaaatacggccgttcgaaaacttattttatgtgtcgcttgtgaagcgtcaagaaaacgcatgtcgcaacgcggattgtttaatttgccgattaaacgcaggggaatggcgatggaaacgcgcatattcgtttttcatcccggatatcgaaaatgcgcacgacgattcaataaaaacccgccgggaggcgggtttttgtgcggtgacgcttttcgcgtgctcagcgcttcagtttcgcgaacgccgcggccattgcgccggccggttccggctcgcgcgaacgctgcgggcgggcggcgccgcgccccgcgttgccgcgatcctggccgccgcgcgacggcgtgccgggcgctgctgcctcgtcgtcgaggcgcatcgtcagcgcaatccgctggcgtttcacgtcgacgtcgagcaccttcaccttgacgacctggccggccttcacgacttcgtgcgggtccttgatgaacttcgtcgacatcgcggacacgtggacgagcccgtcctggtgaacgccgatatccacgaacgcgccgaacgcggcgacgttcgtcacgacgccttcgagcgtcatgcccggcacgagatccgacaccttctcgacgccttcacggaacgtcgcggtcttgaactccggacgcggatcgcggcccggtttctccagttcggacaggatgtctcgcacggtcggcaggccgaaacgctcgtcaacaaattccgtcggggacaggcccgacagcgcttcgcggttgccgagcacgtcgtcgatgcgcttgctgatcttcgcgagcatccgctcgacgaccggatacgcttccgggtgcaccgacgagcggtcgagcggattctcgccgccgttgatgcgcaggaagccggcggcctgttcgaaggtcttgtcgccgaggcgcgggaccttgcgcaggtgctcgcgcgacgggaacgggccgtttgcgtcgcggtagtcgacgatgttgcgcgcgagcgtcgcgttcaggcccgacacgcgcgccagcagcgcggccgacgcggtgttcgcgtcgacgccgaccgcgttcacgcaatcctcgacgaccgcgtcgagcgagcgggcgagttcgcgctggttcacgtcgtgctggtactggccgacgccgatcgccttcggctcgatcttcacgagttcggcgagcggatcctgcaggcggcgcgcgatcgacacggcgccgcgcagcgacacgtccatgtcggggaattccttcgccgcgagttcggacgccgagtagaccgacgcgccggcttccgacacgacgattttctgcaggcgcagctccgggtgtttcgcgatcagctcgctcgcgagcttgtcggtttcgcgcgatgcggtgccgttgccgatgctgatcagctcggcctgcgtctgcgcggcgaggcgcgcgagtttcgcgatcgagccgtcccagtcgcggcgcggctcgtgcgggtagatcgtatcggtcgcgagcaccttgccggtgcggtcgacgaccgcgaccttcacgcccgtgcgcaggccggggtcgagaccgatcacggccttcgggccggccggcgcggccagcagcaggtcgttcaggttgcgcgcgaacacgcggatcgcttcggtttcggccgtttcgcgcagctgcgtgaggagttcgttctcgatgtgcggctgcaccttcacgcgccagcaccagcggcatacgtcggacagccatttgtcggccggacggttctggttcgcgatgccgaaatggcgcgcgatcatcgcctcgccgggatgcggcacctgggcgtcgagctcttcgccgaggccgagcttgatcgtcagcacgcccgcgttgcggccgcggaacagtgcgagggcgcggtgcgacggcacggtcctgatcgtttccgcgtagtcgtaatagtcgcggaatttctcgccttcctcgttttccttgccctcgacgacggccgacgacacgacgccctggctgtgcaggtaatcgcgcagcttgccgagcagctcggccgtttcgccgaactgttcggacaggatgtcgcgcgcgccgtcgagcgcggccttcacgtcggcaacgcccttgtcggcgtcgacgtaggcggccgcctcggcctgcgggtcgagcagcgggttcgcgagcagggcctgcgcgagcggctcgaggccggcctcgcgggcgatctgcgcacgcgtgcggcgcttcggcttgtacggcagataaaggtcttcgagcacctgcttgctgtcggccgcgtcgatcgcggcgcgcagctcgtcggtcagcttgccctgttcgtcgatgctcgacaggatcgccgcgcggcggtcctcgagctcgcgcagatacaggaggcgttcctcgagctggcgcaactgcgtgtcgtccaggttgccggtcacttccttgcggtaccgggcaatgaacggaacggtcgagccttcgtcgaggagttgcacggccgccgcgacctggcgcggctggacggacagttcggtggcgatgcgctgtacgatcttgagtgctacggtttccgtcatgtcgtggatgatctgcctgctgaaatcgcggcgcgggccggcaggcccgaagcggcgggctgcgtggcgggcccgacgggccagatgccgcgggtgagtgaagcggggcattttgccataaatggcggagcgtccagccgggggtgatagaatttgacacatgtcccgcagctttcctacgacgttgccaacttcccgaatttctctcgtcgcgctcggcgcagcgctcgccgcggctttgtctgccgggccttccagcgcgttcgcgcaagcttcgggcgccaccgcgcaggccgccaccgcggccgcacccgtgacggccgcggccgcaccggatttcgacgcccgtcaaaaagtgctcaatcaacgctccgcggaaaacgattatcgttatgcggtggccgagcacgattgctacagcaagttcttcgtcaatcactgtctcggcaaggcgcgtgaccagatgcgcgacgagcgggcgagcatccgccaggagcagctcgcgctcaacgacgagcagcgggcggtgcgcgcgcagcagcgcgaccagcagcaggcgctgaagcaggcgcaggacgcggcggaagcgccgcagcgcgcggcgaacgacgcggcaaacgccgctgcgttccgcgacaagcaggagcagaatgcgctgaagcaggcgcagcgcggcgcggaagggccgcagcgcgcggcgaacaagcaggcgtacgaccagaagcagggcgacttccagcgcaagctcgaccaggcgcaccagcaggccgcgcagaaggcgcaggagcgggcggacaacgccgtacgctacgagcagaagcagaaggaagccgcgcagcacaaggccgacgtcgagcggcgtcagaaggaagcgaccgaaaaggcgcagcagaagcaacagcaggggcagtaacgtgttggattgatccggaatcagtctcgtgcgcgctggcacgccagccggcgcgctgcttcgatgaggaggcaaacatgcaaaaccgtcacacggaacagcagcaggaattgcacaaccgtttggctgcattgcaggagcagcaccagcagctcgctcgggagatcgagctgaaggaagggcactccgacatcgacgacatcacgctgcaccggctgaagaaggaaaagctggcggccaaggacaaaatcattttgctgcaatcgcagctggaaccggataagcgcgcctgagcgcggcctggcaagcgccggcgccgcccgggcgctggacacaggaacgcttgccttgaattcaccgcttgaagccacccccgatgcccggcgcgacgtgtcgtccgccgggcgcgctcgtgcgcccgaaggcacctttgaactgagccgcaagcgcgtcgacgaactcgacacgattttcggcgagggcggattgctggcgcgcgcgctcgacggctatcggccgcgtacatcgcagatcgagatggcgcgcgccgtcgcgtccgcgatggaagcgtccgctcgccggatgcccgagcccgagatcttcgaaacccgcaagcggccggcgcgtcgcctcggcgacggcgacaaggcggccgagacgggcgcggacgccgccgcaaccgagcccgacagcgatgccggggacaacacgctgatcgtcgaggccggcacggggacgggcaagacctatgcgtacctcgtgcccgcgatgctgtggggcggcaaggtgatcgtgtcgaccggcacgaaacatctgcaggatcagctgttccagcgtgacatcccgaccgtgcgcaacgcgctggcggtgccggtgtcggtcgcgatgctcaaggggcgcgcaaactacctgtgccactactacctgcaacgcacggccgacaacggccggctgccgtcgcggcaggatacggcctacctgcaggaaatcgtccgtttcgcgaagatcacgaagagcggcgacaaggccgagctcgcgagcgtgccggaaacggcgcccgtctggtcgatggtcacgtcgacgcgcgacaactgccttggccaggaatgcccgcactacaaggaatgcttcgtgatgcaggcgcggcgcgaggcgcagcaggccgacgtcgtcgtcgtcaaccaccacctgttcttcgcggacatcatgctgcgcgacacggggatggccgagctgctgccgaacgcgaacacggtcatcttcgacgaagcgcaccagctgccggaaacggcgacgctgttcttcggcgagacgctgtcgacgacgcagattctcgaactcgcacgcgacacggtagctgaaggcctgagccatgcacgcgacgcggtcgaatgggtgaagctcggcggcgatctcgagcgcgcggcacgcgacttgcgcctggcgttcgcgaacgaccagatcgtccggatgtcgctcgcccagctcggcgacgatcacccgatgttcggcgcgctcgacgcgctcgaggccgcgctcgacgcgcttgcgtcggcgcttgccagccaggccgaacgggcggaatcgctcggcgcgtgcctgcggcgcgcacgcgaactgcaggacctgctggccggctgggtcgcacccggcgcgacggaggcggccgcgaaggccgatgcggcggcggccggcgacaaggcggcatccgacggcgatccgaacgagaaggtgcgctgggtcgaagtgttcgcgcatacggtccagctgcacgaaacgccgctgtcagtcgcgccgatttttgccaagcagcgcgcgggtgtgccgcgtgcatgggtgttcacgtcggccacgctgtcggtgcgcggcgatttcacgcactacgcggcgcagatgggcctcagctcgcgccgctcgatgacgcttgcgagcccgttcgactaccagtcgcaagggctgctgtacgtgccgcgcaacctgccgcaaccgtcttcgccggcgtttaccgatgccgtcttcgacgccgcgctgccggcgatcgaggcgtccggtggcggcgtgttcatgctgtgcacgacgctgcgcgcggtcgaccggatcgcgtcgaagctgcgcgacgtgatcgaatcgcgcggctggaacacgccgctgctcgtgcagggcgatgcgagccgtaccgaactgctcgatcgtttccgcgcatacggcaatgcgatcctggtcggcagccagagtttctgggaaggcgtcgacgtacgcggcgatgcgctgtcgctcgtcgtgatcgacaagctgccgttcgcgccgccggacgatccggtgctcgccgcgcgcctcgatgcgctgacgaagaaggggctgagcccgttcgccgtgcaccagttgccgcaggccgtgatcacgctgaagcagggcgcgggccggctgattcgcgcggagaccgatcgcggcgtgctgatgatctgcgacacgcggctcgtcgataagccctacgggcgccggatctggcagagcctgccgccgttcaagcggactcgcgagatcgcggtcgtccaggacttcttcgacgagcaccgttccgcaaagcgcacgtgacgatgcgcgcggcgctcgccgcgcgctcgcaccgacgttgcctgagcgcggcgccaataaaaacccggctcgatggccgggtttttgttcgtgcagcgggcgctgcatggtgctttcgtcagaactgccaccacgacttcttcgcgccggggcgcgagtggcccgtgacgtacgggctgtcggggaacgtgcctgcgagcacgcgcttcgtgtcctcggcgagttgcggctggttcagcttgccgtacgacaggatcatgatgtgcagcgcgtcctcgatcgccggggcgcccttgtagtccttgatcgcgagctgcgcacggttgatggccgcgacgtaggcgccacgccggtagtagtagtcggccgcgtgcacttcgtgcgacgcgagcgcgttgacgatgtagcgcatccgcgcggcggcgtcgggcgcgtacttgctcttcgggaagcggtcgacgacgaccttgaacgcatcgtacgattcacgcagtgcctgcggatcgcgctcgctcatgtcctggccggagaaccggccgaacaggccgagatcgtcgttgaagtggatcatccccttcaggtagtacgcgtaagggatatccggatgatcggggtggagctggatgaagcgatcgacggcctggtcggcggcggccgcttcgttgtccttccagttgcagtacgcaacgttgatctgcgcctgttgtgcgaagtggccgaacggatcgcgaccttgcagcgattcgaaatatttcgcgcacttgccccagtcgccgccggacagtgcgtcctgggcctctgagtataatttgttgttcgaccaggtagccgtctcgtcctgcttctgcggcaagccgtggcagccggcgatgagggccgcggccgctaccgccgcagcccgggcggcgacggttctggccgtgcgtttggtcgaattcatcatgctcgcatgtcctagcttcaagtctcggtgacccagtctaaatgacccgttcaagttcgcagaatgcccagccgggcacaccaaatcgcgaagattatagcccaagcgatcggcccgccgacgctgcgtcggggattccctcgatgacgatctggccggcgacgccatgcaggcgcccgtcgtgccgtccgcggcggccgacgacgcgccgcgcgtcgtcgaagtgccgctgtcgctcgcgggtgagcgcctcgacaaggcgctcgcccaactgttccctgaattctcgcgcagccgcctgcagagctggatcgaggcgcagcgcgtgctcgtcgacggcgcgccggcgaagatccgccagccggtgccgctcggcgccaagatcgagctcgtgcccgacctgctccccgagcagctcgcctttacgcccgaaccggtgccgctcgacgtgatctacgaggacgacgcgctcgtcgtcatcaacaagccggccggcctcgtcgtgcatccggccgccggcaactggagcggcacgatcctcaacgggctgctgcatcgctatggcgacgcggcggccggcctgccgcgcgcggggatcgtccaccggctcgacaaggagacgtcgggcctgatggtggtggcgcgtacgctggccgcgcagacggacctcgtgcgccagttgcaggcccgcacggtgaagcgccgctatttcgcgctcgtgtggggcacgatgcccgaggagggcacgatcgatgcgccgatcggccgcgatccgcgcgaacgcacgcgcatggccgtcgtcaccggcgcatcgggcaagcccgcgcgcacgcatttccgcacggttgacacatgcctgtggcaacgtcagccggtttcggcgatccagtgcgatctcgagaccggtcgcacgcaccagatccgcgtgcactgcgcgcatgccgggcacccgctgctcggtgaccccgtgtacgggcgcgcgcgcggcaagcgctcggtcgcgccgttgccggacggtttcgcgcgacaggcgttgcatgcatggcggctcggtctcgtgcacccggtcacgggcaaggcgatgcagtggcgctgcccgctgccggacgacatgaacgccctcgtcgcggcgctcggcttcgggcagggcgacgaggaattcgacgacgatgacggtgtctacgacgatgacgatttcggcggcgagtatcacgacgatgagccgtacctggacgacgaggaggagtgagtgccgatgacgaacctggcgccgttgacgtggcaggactgcgtacagcccgactggcaggtgtcgccgcgcgtgcgcgcgctgatcacgacgcgcgacggcggggtgagcgaaggcccgtatgggcgctggcagggcgcggaagctctgccgggcgggatgaatctcggcctgcataccggtgacgatccggctcatgtcgccgggaatcgcgcgcgcttgctcgcgctggctggccagtcgagcgccgcgtggctcgagcaggttcacggcgcgcagatcgtgcgcgcggacgaggtgatcgcggcggcacccgcggcgctcgcgccggtgcaggccgacgcgagtgtcaccgaccgtgccggtgctgtctgcgtcgtgatggtcgcggattgcctgcccgtgctgctgtgcgacacgcagggccgcgccgtcggcgccgcgcatgcgggctggcgcggcctggcggccggcatcgtcgaacagacggcggcgcgggtcgcggcactcgcgggcggtgcgacggacgcgcttcatgcttacctcgggccggcgatcggcccgcgggcgttcgaggtcggcgccgacgtgcgtgatgcgtttctcgacacggccccgcagtcggagcatgatgaaacccggcttgcgttcgtcgcgatcgatggcgcgcccggcaagttcctggccgatctctacgcgctcgcgcgcttgcgtctcgcgcgtgcgggcgtggcgcacgtgagcggcgggacggcctgcacggtcaccgaacaggcgcgcttctattcgtaccggcgcgaccgcgtgacgggccgcatggcggcggcgatctggctggcggattgacgggatgcgcatgggcgcgggatttgtcgcgctgcaaaatcgggttatctcgattttgcggcggccatgccgcgttacatgcgcggctgaatgaaaaatgcgaagtcaagtcaatcaaaatgttttatgtttcgccggaacccttgtcccgcctgttgcgcgaggattatctccgtgcggaattgttcagcggtttgatatggcgcttcacatggggaaaacgataatgataaaaataccgcactgcggcagaatctggagacgcctctccagagcatgacggcccggctcgcagccggcatgccgcgcgcgagcaggatttcacgacagacgctcacgaatcaccggtaaggcaggtaatgacagcatcgaaaaatcgtcgacgtccgctcaggcgggcacttccacgggcagcattggtttcgatccggccgcccagccgatgcagcagatgttcgagtcgtggttgaacgcgtggcgcggttttgcggatccggcacgtgccgcgactgcgtcggccaccgcgaatccgttcgcgacattccagtttccgacatcgtttccgttccaggtgccgtcgatgcccgatttcggcgcgatggcgtcgccgttcgccgggctgaagctgccggccgccgcgattccccgagcggcttcaggcgttgcaggccgactacgcgcgcgattgcatggcgctgatgcagcaggccgccgccgcgaagctcgagtcgcccgaactgaaggaccgccgctttagcggcgatgcatggaaggcgtcgccggcgcatgcgttcgcggcggcctggtatctgctcaacgcgcgctatctgcaggaactggccgacgcgcttcagaccgacccgaagacgcgcgagcgcattcgtttcactgtccagcagtggacggccgccgccgcgccgagcaacttcctcgcactcaatcccgatgcacagaaatcgattctcgagacgcagggcgaaagcctgcggcaggggatgatgaacctgctcggcgacctgcagcgcggcaagatttcgcagaccgacgaatcgcagttcgtggtcggcaagaacctcgggtgtactgaaggtgcggtcgtctacgagaacgacctgatccagctgatccagtacacgccgaagacggacaaggtgttcgagcggccgctcctgatcgtcccgccgtgcatcaacaagttctacatcctcgacctgcagcccgagaattcgctcgtcgcgcatgcgctgtcgaacggccatcaggtgttcctcgtgtcgtggcgcaacgcggacgcatcggtcgcgcacaagacgtgggacgactacatgaacgaagggctgctcgcggcgatcgacgccgtgcagcaggtgagcggccgcgagcagatcaacacgctcgggttctgcgtcggcggcacgatgctcgcgaccgcgctcgcggtgctcgccgcgcgcggcgaacatccggtcgcgtcgatgacgctgctcaccgcgatgctcgacttcagcgacaccggcatcctcgacgtgttcgtcgacgaggcgcacgtgcagatgcgcgagcagaccatcggcggcaagaacggcacgcagccggggctgatgcgcggcgtcgagttcgcgaacacgttctcgttcctgcggccgaacgacctcgtgtggaactacgtcgtcgacaactacctgaagggccgcacgccggcgccgttcgacctgctgtactggaacggcgattcgacgagcctgccgggcccgatgtacgcgtggtacctgcgcaatacctatctcgagaacaagctgcgcgagccgggcgcgttgaccgtgtgcggcgaatcggtcgacctgacgctgatcgacgtgccgaccttcatctacggctcgcgcgaggatcacatcgtgccgtggcagacggcctatgcatcgacgtcgatcctgtcgggcccgttgaagttcgtgctcggcgcgtcggggcacatcgcgggcgtgatcaatccgccggcgaagaagaagcgcagctactggatcaacgacagcgacctgcccgaatcggcggacgactggtttgccggtgcgaccgagcacccgggaagctggtggacgacctgggtcgagtggctcgaccagtacggcggccgcaggtggcgccgcccgcccagcccggttccgcacagttcccggtgatcgagccggcgccgggccggtacgtattgcagcgcgattgacgaaagacggacagcggcgcacgctgtccgatgcaccgcagtttttaacagggccggtagcgatgcgccgtgtcgtgcgggcctggaggaaagggaaatgacggacgtagtgatcgtatcggccgcgcggaccgcggtcggcaaattcggcggttcgcttgcgaagattgcggcgcccgaactgggcgcgacggtgatccacgcggtgctggagcgcgcgggcgtgaagcccgagcaggtgagcgaagtgatcatgggccaggtgctgacggccggctcgggccagaacccggcgcggcagtcgctgatcaaggccgggctgccgacggcagtgccggggatgacgatcaacaaggtgtgcggctcgggcctgaaggccgtgatgctggcggcgaacgcgatcgtcgcgggcgacgcggacatcgtgatcgcgggcggccaggagaacatgagcgcgtcgccgcacgtgctgccgggctcgcgtgacggcttccggatgggcgatgcgaagctggtcgacacgatgatcgtcgacggcctgtgggacgtgtacaaccagtaccacatgggcatcacggcggagaacgtcgcgaaggaatacgggatcacgcgcgaagagcaggatgcgttcgcggcgctgtcgcagaacaaggcggaagccgcgcagaaggcgggccgcttcgacgacgagatcgtgccggtgtcgatcccgcaacgcaagggcgagccgctgcagttcgcgaccgacgagttcgtgcgtcacggcgtgacggcggagtcgctggcggggctgaagccggcgttctcgaaggacggctcggtgacggcggcgaacgcgtcggggttgaacgacggcgcggcggcggtgctggtgatgtcggcgcagaaggcggcggcgctgggtctgacgccgctggcgaagatcaaggcatacgcgaacgcgggtgtcgatccgagcgtgatggggatgggcccggtgccggcatcgcgccggtgcctggagcgcgcgggctggacgccgggcgacctggacctgatggagatcaacgaggcgttcgcggcgcaggcgctggcggtgcacaagcagatgggttgggacacgtcgaaggtgaacgtgaacggcggggcgatcgcgatcggtcacccgatcggcgcgtcgggctgccggatcctggtgacgctgctgcacgagatggccaagcgcgacgcgaagcgcgggctggcgtcgctgtgcatcggcggcggatgggcgttgcgctcgcggtcgagcgtccgtaaccggtcgtccgtaaccggccgttcgccaccggcgaaccgaatccgtgcgccggccgattgcggcttcggccggcgtcacgtgaagtcagagggggctccggcagctctcgaaaccaaaaatggagtgagatttatgtctcagcgaattgcgtacgtaacgggcgggatgggcggcatcggcaccagcatctgccagcgcctgtcgaaagacggcttcaaggtggtcgcaggatgtggcccgaactcgccgcgccgggtgaaatggctcgaggaccagaaggcgctcgggtacgatttcatcgcgtcggaaggcaacgtcggcgactgggactcgaccaaggaagcgttcgacaaggtcaaggctgaagtcggcgagatcgacgtgctcgtcaacaacgcgggtatcacgcgcgacgtcgtgttccgcaagatgacgcacgaagactggaccgccgtgatcgacaccaacctgacgagcctgttcaacgtgacgaagcaggtgatcgacgggatggtcgaacgcggctggggccggatcatcaacatttcgtcggtgaacggccagaaagggcaattcggccagaccaactattcgaccgcgaaggccggtattcacggcttcacgatgtcgctcgcacaggaagtcgcgacgaagggcgtgacggtcaacaccgtgtcgccgggctacatcggcaccgacatggtgaaggcgatccgcccggacgtgctcgagaagatcgtcgcgacgatcccggtgcggcgtctcggcgggccggaggaaatcggttcgatcgtcgcgtggctcgcgtcgaacgattccggtttcgcgaccggcgccgacttctcgctgaacggcggcctgcacatgggctgagcgtccgcgctgcgcgggccgggtggccgcgcagccgggcgtattcgaaggcccccgcctcccggattcgggcggcggggattcgtcacttccgctacgctgcactcaaaggcgttacatgactactacaaagaagacggccgaacggctcatcaagaagtacccgaaccgtcggctctacgatacagagacaagcacgtacattacgctgaccgacgtgaagcaactcgtgctggagcaggaggacttcaaggtcgtcgacgcgaaatccaacgaagatctgacgcgcagcatcctgttgcagatcatcctcgaagaggaaagcggcggcgtgccgatgttctcgtcgtcgatgctgtcgcagatcatccgtttctacgggcatgcgatgcagggcatgatggggacgtacctggaaaagaacatccaggcgttcatcgacatccagaacaagctcgcggatcagtcgaagaacctgtacgaaggcaatgcgatgaatccggaagtctggtcgcagttcatgaacatgcaggcgccgatgatgcaagggatgatgaccagctacatcgagcagtcgaagaacatgttcgtgcagatgcaggagcagatgcagaaccaggcgaagtcgatgttcagcacgttcccgttcaagcagccgggcgcgtcggagccggagaagaagtaacggtttcgcggcaggccgaccgcggcgggcaaaccgtcgggcgtcggtgccgcgaagcaaagcggtgcgggtcggccgatcgtgcattcgggcgcgacgatgtgcggccgccgccagcaggatcatttcgccgacggtcgttcatgaccgtcggtaccgaatgcgcgccgggttcgggcgtgcatgaccgtcgtccagtcgatcgagatccagtcaccagtgaaggaacgccgggcgcgccgcgccggacggtgtgcgtccgtgcaggcgcgcgtaccatgagcggcgctgcaaggtgaagcatggaggctgcctttggcgacatgcgataccggcgcgcgggcacgacaggctgtgacgggcgatgccccaccgatgcggtgcgaccaagaaaaaccgactgagagagagcatgcgagggattcgaatggcatcggccggcaggctggcgggtcttgcttcgatgatcatgatgggcgccggcatggcactaccggcctttgcgatggattgcgcgaaagcggtgcagccgatcgagaagcgcatctgtacgaactccgtgctgcgcgcggccgacgcgcgcatgaactcggcgtactcgggcgcactgaaggccgcgccggacacgacgatccgcgacatgctggtgcgcggccagcgccgctggatcgacgcacgcaacaaccgtctcgacgccgattacgaaggccatccgctggccgtcgacgaagtgcgcaaggccatcgatcggcgtaccgccgtgctggccgatcgatcggacaaagggttgatcgcgcgtgcgctggccgagcgcaagtggctcgcgaattacacgggcggcccgctcaccggtttcgatgcaaactgcgatttcattcccgacgatgcaagtggcgcgcacgtttcctatgcgtgtttcggtgctgtccatgtgcagcatcgtgcacgggtctgcagccagagcgaggactgggcgaccggtgcggtttatcagtaccggtcggtgagcgcggcagacggcgggaaggttcgacccgtggcattttgcgaaacacaggcgcatgagaatgcgtgcgacaacggtggagcgcaatcggcttggatgcgcgcaggggcgtccggtggcgataaccacgcgtcagcgcccgtagccgggttgccgcaactcgatgcggaaatgtggccgatcggcgatggcgacgatgtggtgtggttcgaccgatgcctgaaggcggcggtgtttccggacgtgcgatgaagtgtcgagcccggtgtttgagtaaggcccgcctcggcgggcttttctgtatcgtccgcccgtctcaagtaccgcggatatcaatcgattgattgtttgccgggcgcgagaggacgacgcgattcgcgatgatgggcggcaggcgatcgcacagtggcgaagcggggcgaagcgcggcgaacgggatagtcggaaccccgcaacttccggatgtcactcatgggattcaacccactgcgcgtcgtcgtggtcggcggaggcatcgtcggggcgtcgatcgcgtggcactttgcgcgatcgggtgcgcaggtcacgccgctggaaaagcagccagcggccgcgggcggcgcgactcactggtcgttcggctgggtgggcaccggtagcgcgcttccggagtttgcccggctggcgcgtgagctgggcccgttgccggtgacgacgcgcggggcgcttgtctggctggactcggatgcgcagaccgccgcgttgatcgacgagcagcgcgcggcgggcgctgcgtggtcgtcggttcaggctggtgaaatgcgtgtaacgcgtctctcgtcgtccgtcagtgcgccggatcgaaatcctgctcgccatccgacggaggaaggtcgagcacgagcttgacggcgctgtagttggccttcagcgaaaacacgcggccaatcacgagaaacgtctggcgcgaattctcgagttcgacgaagtcgcccggttgcggcacgtgtgcgccctggtcatacgaaaagctggtgctggtctgctcgccgatggcttcggctgcgtgctcggtgaattcgattgtgatgtgcgtggtcatgcgaaccccggtgggtcgattgaaaaggatgaacgcctggattttcgcatagcggccggctgcgcccggggcgatttttgtgcggtaggtggcatcgatggagtgcgagggtggggttggactccggatagatgacgcgcaggaacaggtgctgcgcgaagtacgctaacgagcccgctgggctgcatgtagttgaccggtccacgcaacgcataggtctgcgaggcggtggtgaggaacccacttggtacaacacctggaaactgaccatcgtcgcagcgggatgctacttcgcgccccatcatcgtgaaatgagacgagtttgaatttttggggcagaaccggcgtattcgtcggcacgacccatccaagatcgtgaatgcaggctgcgtttcgcattcctttggatcgatagtccgcgaaaagagcacacctggatcggcacgaagcgcggcgccgtcagcgcatcaaattcctttgttcggacatcgcgcgggctgttcgggcgggaatgcgttgtttcagagtgaaagggacgcatcaagatgccgcgcatgacgggccgttggcggggcgtgcatccgatttgacggtcgatgctgccgctgaccgcctgttttgcttcgccgaaccctaaatcgctgtaaactcacgcttttgctgccacgccccacattccagatgtcccaatccccaaagtagggttcgtttcgcttggttgcccgaaagccctcgtcgattccgaacagatcatcacgcaactgcgtgccgaaggttatgaaatctccggcacctacgacggcgccgacctcgtcgtcgtgaacacctgcggcttcatcgacgaagccgtgcaggaaagcctcgacgcgatcggcgaagcgctgaccgagaacggcaaggtgatcgtcaccggctgtctcggcgcgaagtcgagcgccagcggctcgaacctgatcgaggaagtccatccgaaggtgctcgccgtcaccggcccgcacgcggtgggcgaagtgatgcaggccgtgcattcgcacctgccgaagccgcacgacccgttcaccgacctcgtgccggcggccggcatcaagctcacgccgcgccactacgcgtacctgaagatctccgaaggctgcaaccaccgctgcacgttctgcatcatcccgtcgatgcgcggcgacctcgtgtcgcgcccggtcgccgaagtgatgctggaagccgagaacctcttcaagtcgggcgtgaaggaactgctcgtgatctcgcaggacacgagcgcgtacggcgtcgacgtgaagtaccgcacgggcttctggaacggcaagccgatcaagacgcgcatgaccgacctggtcgccgcgctcggcgaactcgcggcacagtacggcgcatgggtgcgcctgcactacgtgtacccgtacccgagcgtcgacgaagtgattccgctgatggccgaaggtccgttcaagggccacgtgctgccgtatctcgacgtgccgttccagcacgcgcatccggaagtgctgaagcgaatgaagcgtccggcgaacgccgagaaggtgctcgagcgcgtgcagaagtggcgcgagatctgcccggacctgacgatccgcagcacgttcatcgcgggcttcccggcgagacggaagagcagttcgaaacgctgctcgacttcatccgcgaggcggaactcgatcgcgtcggctgcttcgcgtattcgccggtcgaaggcgcgacggcaaacgaactcgacggcgcgctgccggatgaggttcgtgaggagcgtcgcgcacgcttcatggaagtcgccgaggaagtgtcggcgaaccgcattcagcgcaaggtcggcaagaccctcaaggtgctgatcgacgaagtcagcgaggaaggcgggatcggccgcacggcggccgatgcgccggagatcgacggcgtcgtctatgtcgagccggcggcgaaggcctcgaagcgctacaaggtcggcgatttcgtgtccgtgaagatcacgggcgccgacggccacgatctgtggggcgaggtgtaagcgatggccgccgcattcccggagatcctcgcgctcggcgaagcgatgatcgaattcaaccagtcgcagccgggccggcctgaattcctgcagggcttcggcggcgacacgtcgaacttctgcatcgcggcggcgcgccagggcgcgtcgacgggcttcgtgtcggcgatcggcgacgatccgttcggccggctgctggccgacatgtggcgcgcggaacgcgtcgacacgacgtacgtgcggatcgatcgcacggcgccgaccggcgtgtatttcgtcacgcacggcgccgacggccaccagttcgactatctgcgtgcgggctcggcggcgagccgctatgcggcaggcgacctgccgctcgacgcactggccgccgcgaaggccgtgcacctgtcgggcatcagcctcgcgatcagcacagccgcgtgcgacgccgcgttcgcggcgatcgaccacgcgcgccgcaacggtgcgaaggtcagcttcgacacgaacctgcgcctgaagctgtggccgctgccgcgcgcccgcgcggtgatgcgcgaggcgctgcgccagacggatatctgcctgcccagctgggacgacgtgacggcgatcacgggcgcgaacgatcgcgacgcgatcgtcgacgcgatgctcgaacacgggccgcaggtcgttgcgctgaagctcggcaaggaaggtgcctacgtggcgacgccgaacgagcggcgcgtcgtgccgggcttcgcggtcgaagccgtcgacgcgacgggcgcgggcgactgcttcggcggtgctttcgtcgcgcggatcgtcgcgggcgacgatccgttcgcggcggcgcgttatgcgaacgccgcggcggcattgtcgacgacgggctacggcgcggtcgcgccgattccgcagcgcgaggcggtggagcgcctgatgcaaggctgatgcgcaatacgcgcgccggccgcggcttcgtatgacggccagcgcatcgccgcaatttacgagcgaatctgaagcaaggagcaacacaaggtgggtcgatattcgcaatggcaacgggcgctcgtcgtcgcgggcgcgctggcggcgggcatggcgatgccgggcgtggtcgcggcgcaggctgtcgcgccgggcgtgcagcaggacgaaccggcaccggcgcggccgctgaagccgaatccggagtttgcccgcctgccgcgctacgaaggcacgctcggcgaccggccaatcgtcgtgcatctcggcccgaagacggacgaggaaggcgtgcacggcgaataccagttcgccgatacgggcgaggtcgtgctgctcgcgggcgatcgcgacggcgacacgcttgaaatcgaggaatcgaacgacggcacgaacatcacgggcgtgtggatcggccgcttcgacgcgacgggcaccctgaaggccgatcggatgaattcggacgagtcggatccgcagcccgtcgtgctgcgtctcgcgccgggcaagcgcgcggcgctgcaggtgcgcgacggccgcgtgcaggaaatcgagacggtgggcggcgtcgtcaacctgcgcaccgacaactgaacccgcgctggctcggcgcgcgcggcgcgcattgtaccgggccaatcgtgccgattttggctaatctggcgacttattccgcaaccgaacggcctcgtgcccggcttcctgtcatgactgcatccactcccaagcgcgcgctgcaaacccgcatcgttcaacccgacgacgtgatcccggaaggtttccgttcgttcgtgccgccggtcgcgcgcgcgtcgacggtcgtgtttcccgatctcgcgacgatgcgtgcgctcgtctggcacaacgacaaccagtggcgctacgggctgcattcgacgccgacgtcgctcgcgctcgcgcagcggcttgccgagatcgagggcggcacgcatgcgctgctgcagccgtcgggtctcgcggcgatcatgaacgtctatttcgggattgtgaaagccggcgacgacgtgctgattccgcacaacgtatacgggccgaacgccgatttcggcaactggctcgcgaaggatttcggcatcaccgcgcgctactacgatccgctcgtcggtgccggcatcgccgacctgatccagccgaacacgcggctgatctggatcgaggcgcccggctcggtgacgatggaagtgcccgacgtgcaggcgatcacggcggccgcgaaggcgcgcggcatcgtcaccgcgatcgacaacaccttttcggccgggctcgcgttcaagccgttcgagcacggcgtcgacatctcggtgcaggcgctgaccaagtaccagtcgggcggcagcgacgtgctgatgggcgcgacgatcaccgcgagcgccgacctgcaggcgaagctgaagctcgcgcggatgcgctgcgggatcggcgtgtcggtcgacgattgctcgctcgtgctgcgcagcctgccgagcatgcaggtgcgcttcgacgcgcacggcaagagcgcgctcgcgctggcgcaatggctgaaggcgcggccggagattgcgtcggtgctgcatccgcagatggccgattgcccggggcacgcgtcgttcatgcgcgatttcaccggcgcgggcgggttgttctcggtggtgttcgacgaacgctacagcgcggagcaggtcgaccgcttcgtcgagtcgctcgaactgttcgcgatcggctggagctggggcggtgcatgcagccttgcgatgccttacgacgtcgcgtcgatgcgtccggactggccgcatcgcggcacgctggtgcgtttctatgtcggcctggaagacgaagccgacctgcgcgcggacatcgaacgcgcgatgcaggccgcactcggctgatcgccggccggtcaggttcccggcacgacaaaacgccggcgcgatgcaacatcgcgccggcgtttttcatttgacgcgcggcaggatcagaacagccgcagcagcccgtcgaggccgacgtgatcgaacgcgaccgtcgccgcgtcgcgcacgacgggtttcgcgtggtacgcgaccgacagcccggcttcggccatcatcttcaggtcgttcgacccgtcgcccatcgcgatcgcgcggctcggctcgaggccgagcgacgcgcacgtctcgcgcagcaggcgcgccttcacgtcggcgttgacgatctcgccgagcaccttgccggtcagcttgccgtcgacgatctcgagcgtgttcgcatgcgcgtagtcgaggccgaggcgcgccttcagccgctcggtgaagaacgtgaagccgcccgatacgagcagcgtcttcatgccggcggccttcacgccggcgagcatcgtctcggcgcccggcgtcaattgcagccgttcctcgtacacgcgttcgagcgcgtgcgcgtcgagcccggccagcagcgcgacgcggcgcgtgaggctttcgttgaagtcgcggatctcgccgcgcatcgacgcttcggtgatctcggcgacctgcgttttcagcccgcagaaatcggcgatctcgtcgatgcattcgatcgtgatcagcgtcgaatccatgtccatcacggcgagcccgaaatcggcgagcgtgcggccggcctcgacgaacgcgaagtcgagcgcgtgcgtgccgcagtacgcgtcgatgtcgatgcgctgtgccgggctcgcgtcttcgatgcgcagcgcatgatcgtcggtctgcacgatgcgggtgccgcgcgacagcgcgagcagcggtttgtgatgggcgtccgacagcggcgcaaggctctggatgacgaggttgtgggtcatgacgggatggttgggagacgtatgaaaagcgtgcgcggccaatgggcggccgtctgcgtgcgcggccccgttcgactgcgggccattgcgtcgcgaacgcgccattgtagccggttggccgggccgggcggtcgcggcaggggcgaatcccgaggcccgactcgaaccggtacgcccgcggcgcgagccgaatgaaggcgcctatcgcctgtccgcgcgatcccagtagggtggatcgccgaaatgctcggccaggaacgtgatgaacgcgagcgtcttcagcggcacgtgtgtgcggctcgggtagacggcccagatcgcgacatcgtcggcgaacggatagtcgtcgagtatcgtgacgagcgtgccgctcgcgagcagcgggccgacgtcccaggtcgacttgatcgcgatcccgaagccgtcgacgagcgcttcgcggatggcttcgccattgctcgcgacgagccggccgccgacccgcacggtcagcgggccttgcggcgtggcgaacgaccagtcgcgctggtcgccgaggatcacgcattcgtgctgcgtcaggtcggccggatggcgcggcgtgccgtgctcggcgagatacgcgggcgagcagcacagcacgcggcggttggcggcaagcttgcgcgcgacgagcgtcgaatccttcagcgcgccgaggcggatcgcgacgtcgtagccgtcgtcgaccaggtcgacgatctcgtccgacagccgcaggtcgagcgacacggacggatagcggcgcaggaatgcgggaatcaccggcgcgacatgctgccggccgaacgacgacgacatcgacaccttcagccgcccgtacggctcggtgcggccgtggccgaccgacgcgcgcgcggcgtcggccgccgacagcagcgtgtcggcgtgcgccatgaatacctcgccgtcctgcgtgaggctgatccggcgcgtggtgcggtgcagcagccgtgcgccgagctgacgctcgagttgtgcgatgcgcgcgctcgcgaccgcggccgacacgccgaattcgcgcccggccgcggtgacgttcgcgagcagggccgcgcgaacgaacagcgcgacgtcgagcaggtcgagcggcttgtcgggggccggaatcggatcggaggccattattctgaatttcctgaaaatgtttcaggaaatatagcggttttctcgaatgatcgggttgcctacgatgacgtccatggggctgcgccgcggccccaggtttccagaaggagtttcgtgatgaaggccgttggactgacccgttatctgccgatcgacgatccgcaagccttgctcgacgtggagctgccgcagcccgtgccgggcccgcgcgacctgctcgtgaaggtcgaggcgatttccgtgaacccggtggacaccaaggtgcgcgcgccgaagccgcaggtcgaggacacgccgcgcgtgctcggctgggatgcggccggcacggtggtcgcggtcggtgccgacgtcacgttgttccggcccggcgacgcagtgttctatgcgggcagcatcacgcggcccggcgcgaacagcgaattccatacggtcgacgagcggatcgccgcgctgaagccgcgtacgctcgatttcgccgcggcggccgcgctgccgctcaccgcactgaccgcgtgggaggcgctgttcgaccggctgcgcgtgtcgccgcaggggcggacgccggcaaatcggtgctgatcatcggcggcgcgggtggcgtgggctcgatcgcgatccagctcgcgaagacgctcggcaagctgcacgtgatcgcgaccgcgtcgcggccggcgtcggccgaatgggtgcgtgcgctgggtgccgatgcggtggtcgaccatttcggcgacttgcctgcgcagttgcgcgaggccgggcatccgagcgttgactacgtgctgattttcaacgatacggatcgtcatttccccgccgctgcggaggtaatccggccgcagggcggcatttgcacgatcgtcgagaacgacaagccggtgccggtcgaactgctgaaggcgaaaagtgcggcgtttcactgggagttcatgttcacgcgtgcgatgttcgagacgccggacatgatcgagcagcaccggatcctcggcgaagtcgcgcggctcgtcgacggcggcacgctgcgcaccacgctcggcgaacagctcggcacgatcaatgccgcgaacgtgcggcgcgcgcaccagctgctcgaggccgggcgcgcgatcggcaagctcgtgctgagcggcttctgagccggcatcgcgcgtaaggttgcggcgccgcgaacgcaagcggggtaacacccgatgcgtttgcggcgcacggcatgccgcttggcggtagactggcagcgcatcatgcatcgaaaaccgcgcggcacgcgcgtgccgccgcataccaaggaggtcagcatgagccaacgcagcttgtcagtcgccgcatcgtggtcggtcgtgttcgcggcggcgtgcgtcagcgcgagcgtattcgcggcgccgccggtcaagggcagcctgaagggcggcggcaccggacagctcgaatacaccgtcaaggtcgattcgaagacctttggcaacacgcaggagacccgcaagatccgctcgggcgagacggacgacttcaactggaagtcggtgccgccgagcggtgcggtcgcgatgccggacggttgcccgaacgccgacagcctgccgcgcgacgcgaacggcgcgatggtccgccagacccaggtgcggctcgcgccgtcgatcgacgcgaagggcgtcgccaacgtgcagatgagcttccaggcggccgcgccgaagggcacgcgcaacgtgacggtcggcggcaagtcgctgcaatgcccggacgtcgcgtcggtgagccaggtgaagtgggtgtcgatcccgaccaacggcggttcgaagtccgtcacgatgagcgacggcacgaaggtgacggtgtcgatcaagcgctgaacggcgcgcgcgggccgcttccggaaccggtgcgcgcgcaacggattcggcgcgcgggccggcccggcggcgcgtgagcgtttcgtgtcgccgttacggtgctttcccgcgacctgctcgcggtaccgtgctgctgcaacggtatggcagcagcacggcgtgcggcggcgtcgcgcgtcgaccagcgtgacgtcatgcgaatgtcacgctatgctcgcccgcatcatccacttcccgtaacgacatcccgatgaaatgccgaatccgcgcattgctgtgcgccattgcgttcgccgccatgcacgcgcacgcggccgacgattgcggtttcgtgaaaggtcgggctgccgtcccggcagcaggtggccgtcgtgtcgagcggcgcgctcgaaccgtgctcgaccggcagctacgcggtgcgggtgtattcgaccgcgcatgccgccgccggcttcgataccgacgactacgtgacgggcgcgctgcacgcgcgtgacggtacggtcaccgacgcgttcacggccgacctcggcgcgcgggcgccgcaggcgctcgtcgtgacgacacgctcggccggcagcggcggctatgtcggcgcgcaagcctatgtgacgacgccgcgcgcggtgcggctcgttgcgtcggtcgacgggctcgcagcggacgcggacatcgtggccgcattgcggcaggcgatcggcaagcgtcgcggcgcgcgctgaccggtgaaccgcgcgaacgcatcgcgcggcgacttccgcgtgtcagtgcgtgcgttcctcgagccgcgatgcgagaaagcggtgatcggccgagaacagccggcgataggtcatcagcaccgcgccgacggtgccgagcgcggaagccgcggcgatcaggaacatgatcacgatctggtagcgcacggcctgcagcggcgactggccggctagcacctggcccgtcatcattcccggcaggctcacgacgccgacgacggccatctggttcagcgtcggcagcatgcctgcgcgcacggcctggcgcgcggcgtcctgcgcggcttcccagcgcgtcgcgccgagcgcgagtgcggtttcgacgcggtcgcggcgcgccgtgagctcctccatcatccgctcgacgccgagcgacacgcccgtgagcgtattgccgagaatcatcccgaggatcggaatcgcgtattgcggtgcgtaccacggatggatgcggatcacgacgaacaggccgaccgccgcgacgaaccagctgctgaaccagatcgacgcgatgctgtcgatgcgctggccgcggtaggtgcgcttgccgcgccccgcgccggcgaaccctgcgatcaaggtcatcagcgcggtgagcggcagcacgatgtaccagtgaggatgaccgaacacccagccgagcacgtagccgatcgcgagcaattgcacgacggtgcgcacggccgcgagcgcgagcttgcggccgaggccgagcgacagtgccatcgagatcgcgccgttgaccgcgacgagcgcggcggcgatgccgacgtcgacgaggctcaggtcctgcagtgcggctcattgggttgcctccgtcgggttggcaacgtgtatcacgccggcctgcatcacgagccgcatcgtgccgatccgtgcggcctgggccggatcgtgcgaaatccacatgtacgcgcgggcgtcgggcgccgcgtcgaaccatgcgccgacgagcgactcgatcgcgcgcgccgattcggggtcgagcgcggaggtcggctcgtcgagcagcagcacgtcgggatcgagctgcagcacgcgcagcagcgcggcgatctgcgcttcgccgcccgacaggtcgctcgcgcgcttgtcgagaaagtcggggccgcggccggcctgcgcagcgagcgcttcggcgcgcgcgcgatcgaacgcgacgtcgcgatagatcgcgagcgaatacggatagcgcaactgcgattcgacggtgccgtccatttgcgcggggcgctggcgtacataggcgacgctgcgccggtaacgcgggatcgcgctgcgccggatccgtttgccgcgccacaggatgtggccgccgtcgagcggatcgagcagcgcgagcgcgcgcagcagcacgctcttgcccgacccggacggtcccgtgacagcaattcgcgatcccgctgcgaggcttaaatcggtcggggcgagcagggtcttgccgctgctggcgtcgcgccgcgtgatgtgctgcgcatcgatgaggccggtgggggctgtcatgtcacaaatgaaaaagcgttaatggcgccgaaacgtcaccatggcgtgcgtcataataccgactgaaaagccgcgggtgtcgcgcgccgttcgtccacgcaagcggcccggcatggtgcggcgacatttcagaacaacaacggaaccgccatgacgcttacccgagccatcggcaaatcggctgcatggatcgtcggtatcgtcgcggtgctcatcgcggcggccggcgtctttctctttacattcgactggaaccgcgcgaagccgtgggtcaacgaacaggtgagtgccgcactcggccgcccgttcgcgatcaacggcgatctcaaggtcggctggcgccgccccgacggcgaaaccggctggcgtgcctgggtgccctggccgagcttttcggccacgcaactcgagatcggcaaccccgactgggcgaagacgcccaagttcgtcacgctcgacgccgcgcacttcgacctcgcgatcctgccgctgctcgcgcatgaaatcgtcatcccgtcgatcgacgtcgtgaatccggccgtcgacctcgagcgcctcgccgacggccgcaacacgtggaccttccagttcaagcaatcgtcgcagccgtcgccgtggaaagtgcggctcgacagcttcggcttcgcgaagggcaccgtcacgtatcgcgacgcgatcacgaaggccgacctgaccgtcgcgatcgatacgctcgggcagccgattccctcggcgatgtgctgaaggagcaggagcagacatcgcgcgcggcatccgcgcagcgtgtcggcaagcgcggcgccgcgcaactgagcgcgaaggccaacgcggaagccgcatcgggcgcgtccgccgcgcaggccgcgagtgcggcgtcggggctgggggcttcggctgcatctgcggcggtatcggcttcgtcgtcgtccgcttcatcggcgtcggtcgcggcgcccgcgaagccgtctggcccgacctatgcgttcgggctgaaggtcgacggccgctacaagaacgtgccgatcagcggtaccggcaagctcggcggcgtgctggcgatccaggatgcgtcgcggccgttcccgctgcaggccgacgtgaaggccggcgacacgcggctcgcgatcgtcggcacgctgaccgatccgatgcatctcgcggcgatcgacctgcggctgtggctgcagggcacgtcgatgtcgcacctttaccagctcaccggcatcacgctgcccgacacgccgccttacgcgacggaagggcggctgatcggcaacttcaagcggcgcgcgagcacgttccgctacgagaacttcaacggccgcgtcggcggcagcgatctcggcggcacgctggtgtacgagcagcgcgagccgcggccgaagctgtcgggcgagctcgtgtcgaacctgctgcagttctcggacctcgcgccggtgatcggcgcggatacggccgcaagcaaggccaggcgcggcgacacgacacgccagccgccgggccgcgtgctgccggtcgagacgttccgtaccgatcgttggcgcgagatcgacgcggacgtcaagttcacgggccgcaagctgatcaagagttcgaacctgccgatcacgaacctgtacacgcacatcgtgatgcaggacggcgtgctgtcgctcgaaccgctgcagttcggcgtcgcgggcggcacgctcgcgacgaccgcgcacctcgacggcagcggcgcgccgttgaagggccgcttcacggtggccgcgcggcacctgaagctcaagcagctgttccccacgcagaaggtgatgcagtcggcgctcggcgagatcaacggcgacgcgtcgctgtcggcgaccggcaactcgccggccgcgctggccgcgacgtcgaccggcgaagtgaaggcgcttgtcacggacggccgcatcagccgcctgctgatggaggcggcggggctgaacgtcgcgaacgtcgtgtacgagaagctgttcggcaacaatgacgtgaagatcaattgcgcggcagtcgacttcgtcgcgaccaacgggatgctcgacccgaaggtattcgcgctcgacaccgacgacgcgctgatcaacgtcgacggcccgatcagcctgcgcgacgaaacgctcgacctgaagatccatccgcacacgaagggtttccggatcttctcgctgcgctcgccgctgtatgcgaaaggcacgttcaaggatccgaaggtcggcgtcgatgcgggcgcgctcgcgctgcgcgccggcgcgatggtcggcctcggcctgatcaacccgttcgcggccttgatcccgctgatcgcgccgagcaacaacaaggacgtgccgtgctcggagctgttcgggcaggtgaaggcgacagcggcccagaaggccgccgcgaaagccggcaagtgacggacgtgcggcgcgcggtgagcgcgacgcgcgtgcggccgatgcaaccgccccgcgctcggcgcaggcacgcaacgacccgccgcctggccgtatcgatgtatcgccccggcgaactgtgtcgaccgttcgtggcgcgtcagctacccgcgcgcgcccacagcagcacggcgtcgacttcccggccgtcgatccgcacggggccgacggtgccgagctgcaggcgatcgccgtcgagcctgaagacccgctgctgcacgttgccgatccagttggggaacaggctgacgtccatttcgtgggtcagcgtgccgtcgtcgtcgagatgaaaggggcctgaataggcaatgtagccgcgtgcggcggccgtgcactcgctctcggtgccgcggtgcagatcgccgctcgcgtacggcgggcggccggcagccatctgggccgacatgtaaccgtcccgcgtatagagaatccagccgcgcgcgtcgcggccgagcggataggtgacggcgctgccgtcgcgcgggcggatttcgtaggacacgaggcgccacgcgccgacgagttgttcgcgaagctggctggcaagcatgcgggattcctgtcaggcggcggcggggcgcgtgccgtcgtgttggcgggccgccgggcggccgtccaggggctggaatgcgctgccggaacggcgtggtcggcagtttctccgacacctgctaaaatacacggttttccgtcgatttatcctttaacgggacctgccgtgctttctactgccaacatcacgatgcaattcgggccaaagcccctgttcgagaacatctcggtcaaattcggcgagggcaaccgctatggtctgatcggcgcgaacggctgcggcaagtcgacgttcatgaagatcctgggcggcgacctcgagccgagcgccggcaacgtcgcgctggagccgaacgtgcgcctgggcaagttgcgccaggaccagttcgcgtatgaagacgtacgcgtgctcgacgtcgtgatgatgggccataccgagatgtgggccgcgatgaccgagcgcgacgcgatctacgcgaacccggaagccaccgacgacgactacatgcacgccgccgagctcgaaggcaagttcgccgaatacggcggctacgacgccgaggcgcgcgcgggcgcgctgctgctcggcatcggcatcgaggagaagttccacaacggcacgatgagcgacgtcgcaccgggctggaagctgcgcgtgctgctcgcgcaggcgctgttctcgaagccggacgtgctgctgctcgacgaaccgaccaacaacctcgacatcaactcgatccgttggctcgagcacacgctcaacgagtacaactcgacgatgatcatcatctcgcacgatcgtcacttcctgaactcggtgtgcacgcacatggccgacatggactacggcacgctgaaggtctggccgggcaactacgacgactacatgctcgcatcggcacaggcgcgtgagcgccaggccgcggcgaacgcgcgcgcgaaggagcgcgtggccgagctgcaggacttcgtgcgccgcttctcggcgaacaagtcgaaggcccgtcaggcaacgagccgcgcgaagcagatcgacaagatcaagatcgaggaattcaagccgtcgtcgcgtcagaacccgttcatccgcttcgagttcgagaagaagctgcacaacgtcgcggtggtcgcggaagacatcacgaagaagtacgagcgcacgatcttccagaacttcaacctgtcggtgcagccgggcgagcggatcgcgatcatcggcgagaacggcgcgggcaagacgacgctgttgcgttcgctgctcggcgcgctcccgctcgagcacggcacggtgaagtggtccgagaacgcgaatgtcggctacatgccgcaggacacgtacgaggagttcccgaacgacatcacgctgatggactggatcgaccagtaccgcaaggacggcgacgacgaaacgatggtgcgcggcacgctgggccgcctgctgttctcgtcggacgacatcaagaagtcggtgaaggtgctgtcgggcggcgagaagggccgcatgatctggggcaagctgatgctcggccgccacaacgtgctgctgatggacgagccgaccaaccacatggacatggaatcgatcgagtcgctgcagatcgcgctcgagcagttcgaaggcacgctgatcttcgtgtcgcacgaccgcgaattcgtgagcgggctggcgaaccggatcatcgaagtgcgcacgaacggcacgctgttcgacttcggcgggaattacgaggagttcctgacgagccaggggcaggaataagtgtcctgaggcttcctccggccaagtgccgcggctggacaggcaagcagtgcctccagccgtccccacggagcgaaccgccggaagtaaatcgggcccgcatcgacagcgttgtcgatgcgggctttcatttccgcttgccgcgcggcccggcagcgtttctcattccggtttcctcccgcgaatcgacttcgggtaaattacccaccgaacgccaatcatcattccccatttcaacccggagccgcccccgatgccggaccatcctctcccgctcgatctgtccggccttgcgcaaagcctgtacgcgcagggcaccgaggaaggcatcctgtcgcgcctgatggagcggatcgcgccggtcaaccggttctgcgtcgatatcggcgccagcgacggcctgcgcaacagcaacaccgcccggttgctgcgcgaacaggactgggccggcgtgctggtggaaggcagcgcgtaccggttcggcaagctggccgcgcactacgcgggtgcagagcgcatccgcctgcatcacgaccgcgtccagcccgacacggtcgatcatctgctcgccgacgcgaacacgccgaccgacttcgacctgctgtcgatcgatatcgacggcaacgactactgggtctggcgtggcctgcaggcgttcaagccgcgcatcgtcgtgatcgaatacaacccgtactacacgccgcccgagcgttgggtcatgtgcttcaacccggatcacgaatgggacggctcgacctattacggcgcgagcctcgaatcgctcgtgcatctcggcaggcagaagggatatgaactcgtctgctgcgacgacatgggcaacaacgcattcttcgtgcggcaggacctgtatccgctgctcggcatcgcgaacaacgatccttcggtgctgttccggcccgcgatgtacaagctgcgctatgtcggacacaacacgttcctgaccggtcatccgtatcggcacgggccggccgagcacatctgaatgggcccgctcgccgcgaccttcgacgagatcctggaagcctgcgcgctcggccgtagcgggccgctgcgccaggtcagcgaacgcgtgtggcacctgccgaccgatgacggtggcgtagcggtcaagctctacgcggccgggcatcaggcgcgtgcggccagggaagcggcggtgctcgcgcacttcgagacgcacggcgatacacgtttccatgtgcaggcgctgaaacgcacggcagccggcgcaccgctgtggacgggggcgaacgcccacgcgatgctcacgcgctgggaaaccgggcagttcagaacctacgacacgttttcgccggccgaatgggaggcgctcggcgcgagcctggccgcgttgcatctgagtctcgaacggcttcagttgccatcgctcgacacgatccgtgcgcggttgatcgcgatcgacgcggatgcggtgcggcgcagtttgctcgatgcgctgaatcacgcacgctcgaacaagaacgccgcgaacctgcgccgctacgtcgatctcgcgctgcgcatgctcgaccgctactatccgggcagcatcgacgcgtttcccgccgacgatccgcagcacccgatccacaacgactacaaccagttcaactatctgttcacgggcacgctgccgccgctgatcctcgactgggaagcgacgatcggcgcgccgcgcgaatacgaactggtgcgttgcctgaatcatttgccgctggaagcgccgccgctggcggaagcgttcgtgcgcgcatacctgcgggtgcggccggtggatcctgcacgcattgcctgggcggtcgatgccgcatgcctgcagcacgcgctgaagctctggatcgtgcaaggctggctcgacgacccgttgcgtttcgcgtcgcatctgagcggcgcggtgacgatggcatccgcgatggtggatgcccgcgaccgcctggtcgatttcttttcccgttgcatcgaagcaggacgctgaagtgaattcgaacctgaaccggatgccgcatccgacgtcgccgccgggcgagcggcagcacgtatttccgccgccgctggatcgcgactaccgtgtcgaagacgggcgcgtcctgacgcgctcgctggaagcgcatatcgtcgaccactgcaacctgacgtgcgcggaatgctgttcgctgtcgccgcttctgccagagtggtatgcgagcccggcatcgctcgaggccgatctgcgccgtgcggcgaaggtgctgcgcccgcgcatgttcaagctggtcggcggcgaaccgctgctgcatccggcgctcgtcgagctcgtcgggcgcgtgcgcgccacgggtatcgcgcccgtgatctccgtcacgacgaatggcctgaagctcggcgggatgacggacgcgttctggcaggcggtggacgcgctgacgatctcgcgctatccgaagccgtcgctttcggccgacctggtcgcgcacatcgagcaccaggccgcgcgcttcgacgtgcgcctgaactggaaggtgcaggacgtgttcacgacgatgaaccgtgcacagcccggcaccgaccgggacgccgcgcagcgcctctatcacgattgctggattcgcgagcgctgccatatgattcgcgacggcatgttctatacgtgcacgcgtccggcgcatttccacacgctctacaagggcgagaaggattttcgatccgacggcctgccgctgcgcgacgacgcgggcatgctcgacgcgatgctcgcctatctgcaacgcgaggcgccgctcgaagcgtgcctgcattgccagggcggcagcgcgccggtggcgccgcaccgcatcctcaaacgcattgaagtggactccttgaaggctcgttatccatgatcgtcggcacgcgcgacctgttcggcttcgaccggcttcactaccatccgcgcagcggcacggcggcgtccggcatccgggccgtcctgcgcgcgtcggcgcaaccggccggcgagcccgacgcggcggccatcgcgggctacctgagcggcgagcgcctggtcggtcgcaccgtgctgcgcgacgtgcgcgcggtgccgcccggccatgcgctgatccgttcgccgcaagggctggccgttcagccggcacccgggcggccgcagcacgcggatctggaaaccgtgctgcgcgcgtcgctgcaacgtgcgctcgacagcggcaagcgcgttgcgctggcgttgagcggtgggctcgattcggcgctgctgcttgcgctgctgcgtgaactcggcgcgcagcggcacgtgacgtcctacatcctcgtgaccgacatgccggactattgcgaacgcgatgcggcactcgaactggccgggcagatgcaggcgaacgtgaagctcgtgcgcgtgaacgaggcggatttcgtcgcggcgctgccgagaacgacccatgcggtcgaggagccgatgttcaacctgcatccggtcgcgaagctgctgctggccgaggcgatggccgcggacggcgtcgaggtggccatcaccggcgacggcgcggaccaggtgctgcgccgcgaccagtcggccaactatctgccgctgtgccatgcgttgttcgatgcggcgtcggtcgacctgcatccgccgttcgtcgacgatgccgtcgtcgcgcatctgaccagcatcgcccccgatccggacaagcaatgcctgcgcgatctcggtgcgcgcctgaacctgccggaccggctcgtgcatggccccaagcgcggccggctcgccccggcgatggatctcgcgacgctgctcgatcgcgaccgcacgcgcgcgctggccgacacgctcggtctggacgcgcccacgctgcaaacggacaacgaacgcgtgctgtggacgacgctgtcgctgatcctcgatcatttcgaccgcctcgacaccccctcgatgccgcgcatcgcccaacctgagccgctcatgaaacgcatcctgttctgcgtggtgcccgagaaagggcacgtcaatccgtgcatcggcccggcccagcatctgcgcgccgccggttgcgacgtcgcgttctatgcgccggccgacatcagcgcccagctcgacgccgccggcggcttcgcgttcgtcgggccgcgcgagacacccgagcgtcacgacctgtcgcgcggcgcgagctttgccgcgaacatccgcgacgcggactggctgcggcactggatccgcacgctgctgatcgacctggcgcccgcacaggtggacggcatccgcgcggtgctgcgcgactggcggcccgacgtggtcgtgatcgatccgctgctctatgcggcggcgatcgccgccgagctggaggggctgccgtgggtggcgatgtcgaattcgctgaatccggtgctgccggacgatctcgactccgaattgctgcgcacggtgcgatggctggcgccggaacgcacccggctgttcgcgcgctacgggctcgatgcgcgctttcgcggttgcgacatcctgtcgccgcacctgacgctcgcgttcacgaccgacgcgctggtcggcgcgccgccgcccggtgtcgaactggtcggccccgcgctgccgtccggcccgcgtggcgacgagacgccgttcccgtgggagcgcctcgatgccgatcgtccgctcgtctacatgtcgctcggcagccagctttattaccatcccgatgtgttcgcgaaagtcatcgaggcggcgcgcgcgacgccggcgcaactggtgttgtcggtgggcgagctggtcgatgcggatctgctgccggccgacgacgcgcgtgtcatcgcggtgcgttacgtgccgcaactggcgctgctgcgacgcacgcacgcgttcgtcagccatggtggcgcgaattcggtgatggagtcgctcgcatgcggcgtgccgatgttgctgtcgccgttctgcaacgaccagtttcattcggcgcacttcgtcgagcgggccggcgcggggcgcgtgctggatctgcaacaggccggcgtggccgagattgccgatgcgctcgcgtgcctgttgcgccccggttcgttgcgcgagcaggcggcgcggatccgtgcgagctacgcgcgtgacggctcggcggaggccgcgcgcctgatcagcgaactcgcttcaggaaaccgcctggcgacagcgtcatgagtacgcggtcttcgatgtcgtagtcgacctcgaaccggtcgtcgcggtcgagatagtcgcgcacggcggtggccgggttgttgcctttgccgtacggcttgccgtcgaacatcgacgcgggcaggtattccatgacggtatccatcacgatcgcgtagctgcccggcgtcacgagcggcgcatagcattcgagttcgcgcagcacgtgcgcgtgggtatgcgtgaggtcgaggatcgccatcacgcgcgcatcgtgcgggatctgcgcgcgtaccgatgcgagcgtgtcggccgcgcacgactcgccttcgatcagcaccatgcgatcggcgagccgatgcgactgcaggcgctgcctgacgtcgtcgcgcaggcgcggctcgatcgcgacgacacggccgcgatcgccgttcagcgccagcatcgacgcggagaacacgacgccgccgcccgccgcgatgccggtctgcacgatgcagtcgggacgctcgcgccagatcagttcctggagcgcgagcatgtcgccgggcaagtggaagaagcgctcgccgagccagcgcgtctggaacaggtggtcgaattcggcggcgcgcgtcagccattcgatgttgatgtcccgcatgcgggccgaaggacgctctgacatggtcaatgcaacgagtaggagtgacgtgaaaacgctggaaccgtggcttcaccggtattggaacatcgggcctgcacgcatgcaggcgctggcgtcgggccatactaacaaaacgtatctcgtcgagtgcgatgcgggacgcgcggtgctgcgcgtgtcgtggtccggcaagccggtcgggcaggtggatcgcgaggcggcgatactcggtcatctcggtgatacgcggacggcgctgctgccggcgctgccgcgcctgcggccgaccgtggacgcgcaatccggtgtgcgactgcctgacggaagctggctgcatctgttcgagcatatcgacggcagccccggcctgccggaccaagcggaggcgggcgcgatcgatgcgatgcgtatgctcgcgcatctgcacgcggcgctggcggcgatacccgtgaccgaatcggcgccgctggctggctgtcggcgcggcacgcacgcgttgccgcgcgtgccgcgccgccgttgccgggagacctgagcgaccgctacgggacgatgatccgtcggatcggcgcgcatctcgacgctgccgcacgctggctgacgggcacggtgcactggctgcacggcgactatcacgcgggcaacctgctgtacgtgggggcgccgtaaacggcgtgctcgatttcgacgacgtcgggcagggcgcgcagtggctcgaagcggcgtttgcgctgtttgcgctgtcgcgcgatgcgggtcgggacgatcgcttcgtattcgacgcgcgccgctgggacgccggcctgctggcctatgcggcgacgcggcccgatgccgtgcctgactggatgcacgaccgccgcgacgcgctgatggccctgttctgcgcggaccagacgctgattcacctggaagccgcgcagcgcggctatgggtgccggggcccggcatcggttttctcggcggctggcggcagttgctggatggcgctgcgccctgacgccggccggatgccacgtcagcgcggccgattcaggaacaggcgcacggcttcgaccgtgttgggccgcgcctcgccgtgccgcgatccgtcgtgcatgcagaacagtacgtcgcgccgccgtgccgtgctggcgtcgacatgggcgcacatcgcgtcgaacagcgcctgcggcgacggcgccggccgctgccagtcgtcgaggatcgcggtccagccggtatgttcgcgctgcaaccgcgcgagcacgcgggcgcgactgtcctgcggcatcagtccataaggcaggcgcagcgggatcgcatccggcgcgggcacgcgggcctcgcgataggcatcgcggatcagcgcgtcggtcgtctcgatctcgtcgatcaacgcgtcgtccgacagcgtgcccggcttcgcgtgcgaacgggtgtgattgccgagccggtggccttcgcgcgccatgcgtgcggccacatcgagcgcgcctgccagattccggccgagcaggaagaaggtcgcgcggcacgacgcggcgtgcaggacgtcgagcaggaggggcgtcgacggaccggggccgtcatcgaaactgaggcaaatgggcatcgcaggtgggtgcgccgttcaaggtgtaccggggaacgatagcgcaagtcgcggcgagcggcagccgtcggccggctactcgcgcggctcgatggccaatggacaggtgccgacccgacgcaagcgcgtaccggtccactcgtagaagaaccgggccgccttcgcgtcgttgtagtcgcaatcgtcgttgaagcagcccgcgacgatcagcagcgtactgccgggctggaaatcgacgcgctcctcgtcgttgcccatcacgcctgcgatggcctgtacgccgggcatcgtgtacgtcgcgcccgtgtacttgtcgacgattgcgaaattccggcaatccgttccgcaaccccaggtcgcgacgcggtagtggccggcaaagttggccggttgcgtgaattcgtcgcgaatgacggtgcggtagaggcgggcttccctggtggtcaggcgtggtgccgcggcgggcttgcgcggtgcgcttgcggcgggtgccggatagcgctcgaacgacggcgaagggcatgcggcggcggccgtggccgcgccggcggtgcctgcgccgcaaccgagcgcggccgctgcgccggcgaacagcagatatcgatgggcaagcgtcacgcgagcgtccttcatgttcgggatcgagatcgggccggacggtccgggcggccggcgacgacgattctatgacgcttcgcgcgcgcaggcgacccggacgggcgatcgcgcgcggatgcaaaaccggcatgtccgcacgcggctcgccgtcaagctttgtcaaatcgtggcgatatcacgatgcctgacgtttcaggccgcctccgaaggctgtcatgcacgggttgattgagtatccttggattcgattcgcggtactcacgcagtcacaaccgggaggcttcacatgaatgcacgtctataccgcgcgaccattgccggtgcgctgatcggattgctcgcgccgttttcggtggcgcatgcgcagctgggcgatgtcctgaagcaggtcggcggcgggggcgattcgggcggcagcgcgggcggtgcgctcggcaacctcggcggcatcggcggcgcgttgacgggcggtggcggttcgtcgctgatgccgggcagcaccggcaacgtcgcgggcctgctgcagttctgcatccagaacaactatctcggcggggcatccggcggtgcgtcgtcggtgaaggacgcgctgatgggcaagctcggcggcaacgcgtcgtccgacagcggctataccagcggtgcgagcggtgtgctcgacgcaggcaatggcagcaagctcgacctgagcggcggcggactgaagcagcaggtaaccaggcagatctgcgacaaggtgctgacgcaggcgaaatcgctgctgtaagcgcgcctcgcgattcggggtgcggtgcgcgacgtaccgcccctgtcagtctttcaggctgacattcccgtcaacgacaggagcgcggtgccgcgcgtgccgtcccgatcgtcaatcggccagccgcttgtcggcgagcgccttgcagcagtcttcgtagacccattgcacgagtttcgcccgatagtcgaggtcgtcggtatcgacgatttcctcgaccgcgtcgcgcgcccacgacgcatcgacgaacccggcgtgccgcttggcgatgtcctgcgcgagcgccgcgagcttggcgatcgcgagccagtcggcctgacggtgatggcggtcgagccagcggtgcgcggcctggacctggaacgtggcgtccggccacgattcgttgagtaaaacgcgccgaggttgccgcaggtgagccagcaaagcagctcgaggcggtcttgcgagccgagggtatggggtgcgtcggacatggcagcgctcacgaaatacgtcgattccgggcggcgccggttgcaacgggccggtgccgatagtaaaaacatagcacgatgcgggcccggccgcgcacccgggcggatgctgacatggcggtggcgaaacggacgccgcgccggcgcggatggccgacggcggaatgagggagcggcgggaacgaaaagtgcgcgagcgcgtgaggaacgacacgggaagatgcggccggggagcgaccagaaagcggtcgcttgcgccgcgaagcgggcccgtcgccgggccccgcagcccggcgcgcgggctggcggatgagcgggatcaggtcgccgtgtgcgtggcgcgcgcgatcgagcggatgctgcgctcgacgcggatcaggatgatcagcaccgcgagcgacacgaacgaatacagcgcgacgagcgcggcgacgccggcgaagcgcgcggtctggccgttctcggcagccgtttcttcggcggccttcttctcgttgtcgatcgccgtccggcgtgcgtcgtagcgctcggagaagtcgcgcatgaccgccgacacgacgtcggtgtacgcctgctcacgcgcatattcgtcgccgtgcccggtgactttcttcttgacgctggccgcgacgtccgcgcgtgacagcaccttgtcgagatacgcgatctgctgctcgtagtacgcgacttccggatggtcgtcgtcgccgagcacgcgctggaacgacggctcgtacgcgtcgcgatcgaccgcgtagtccggcgacagggccgcccggccgtgcttctgcacgatgcccgacagttgcgtcgacaggcgcagcgcgggcgacgcgttgtcgtccttcgctgccgcgccgccggcggccggcgtggccttggcggttgcatcgttctcccacgcgaacgatgcaggatcgacctggatggccgaatcgactttcggcggtttcgacaggcgcgcatcgagtgcgatcgcgccgaatatgaccccgccgatcaggaccgcggtcgcgaacaacagcacgatcacgcgcaatacctgaagatagccgccctcgattttggtcaggatgctcaaggcattctcctttcttatgatgaatgaggcgccgaggctaaagacctttccaatagctgtcaatcgtcacaccggccggccgaaacgctcgctagaatgtcggctttcctggaggcggaaaacgatgaaaatctacgaccagttctatatcgacggcgcgtggcgcaagccggccggcaccggcacgatcgacgtgatcgactcgggcaccgaagccgtgatcggccggattccggaaggcgtcgcgtccgacgcgcaggacgcgatccgcgcggcgcgcgcggccttcgacgcgtgggcggccacgccggcctcgacgcgcgcgggctacctgcgcaagctcgtcgagcatctgcaggcgcgcagcgaggagctcgcgcagtcgatcaccggcgaagtcgggatgccgatcaagctgtcgcgcgcgatccaggtcggcggcccgatctacaactggaaggcgtacgcgaagcttgccgagtcgttcgagttcgaggcacaggtcggcaactcgctcgtcgtgcgcgagccggtggggtcgtcgcggcgatcacgccgtggaactacccgctcaaccaggtgacgctgaaggtcgcaccggcgctcgcggccggctgcacggtcgtcctgaagccgtccgaagtcgcaccgctcaacgcgttcatgcttgccgaggcgattcacgaagccgggctgccggccggcgtgttcaacctcgtgtgcggctacggcccggtggtcggcgaggtgctggccaccgatccggatgtcgacatggtgtcgtttacgggctcgacgcgcgccggcaagcgcgtcgccgagctggcggccgcgggcgtcaagcgcgttgcgctcgagctgggcggcaagtcggcgtcggtgatcctcgacgatgccgatttcgcgacggcggtgaagggcacggtcaacgcgtgctacctgaacgcggggcagacctgctcggcgcacacgcgcatgctggttccggaagcgcgctacgacgaagcccgcgagatcgcgaaggccgcggccgaatcgtacgtcgcgggcgacccgcggcaggatgcgacgcgtctcggcgcgcttgcgtcggccgtgcagcagcagcgcgtgcaggagtacatccagcgcgggatcgacgaaggcgcggagctcgtgacgggcggcacgggcctgccggaagggctcacgaagggcttcttcgtgaagccgaccgtgttcggccgcgtcgatccgaaatcgacgatcgcgcaggaagaaatcttcgggccggtgctgtcgatcatcacgtatcgagatgaggacgaggccgtgcggatcgcgaacgattcaccgtacgggctcggcggcgcggtgtgggccggcagcgacgaacgtgcgatgggcatcgcgcgccgtatccgcaccgggcaggtggacatcaacggcggcacgtggaacggcgccgcgccgttcggcggctacaagcagtcggggcatggtcgcgagaacggcgtgtacgggctcgaggaatatctcgagtacaagtcgatgcagctcaagcccgcgaagcctgcctgagcgcttcgcgccgcacgaaccgaaaacggcacgctggtgccgtttttattgacggtcgtcaaggtgcgcggcggtggatcgtcgatcatcgcggttccgatgttccgacgaggtttcagatgaccgtacgcacttcctttccgccgctgacgatccgcggccgcaccttgctgcctgtcgtgcagggcggcatgggcgtcggcatctccgcgcaccgcctggcgggcagcgtcgcgcgcgaaggcgcggtcggcacgatcgcgagcatcgacctgcgtcaccatcatccggacctgctcgcgcgttgccgcgcgcaacccgatcgcgcgacgctcgaggccgcgaacctcgaggcgctcgcccgcgagatccgtcttgccaagacctacagcgaaggacgcgggatgatcgcggtcaacgtgatgaaggccgtgagcgcgcatgcggactacgtgcgggtcgcatgcgacgagggcgcggatgcgatcgtgatgggcgcgggcctgccgctcgacctgcccgatctcacgcaaggacacgacatcgcgctgatcccgatcctgtcggacagccgcgggatcgcgctcgtgctgaagaagtggatgaagaaggggcgcctgcccgacgcgatcgtgatcgagcatccggcgcatgcgggcggccatctcggcgtcacgcagatcgacgacatgcacgacctccgtttcgatttcgcacgcgtgctcgacgagaccgcgcaggtgatggcatcgctcggcatcgcacgcgaaacaatctcgctgatcgttgcgggcgggatcaacagtcacgacacggtgcgcgcggcgctcgaggccggcgcgaacggcgtgcaggtcggcacgccgttcgcggtgacggaagagggcgatgcgcatccgcacttcaagcgcgtgctggccgacgcgacgcccgacgacatcgtcgaattcgtcagcgtgacggggctgcccgcacgcgcggtgaaaacgccgtggctcgatcgttacctgcgcaacgagacgcgcatccgcaacaagctcggcgcgctgaagcagcgttgcccgaccgcgctcgaatgcctgagcgtatgcggcttgcgcgacggcatcgagaagttcggccatttctgcatcgacacacggctggcggcggcgctgcgcggcgacgtcgcgaacgggctgttcttccgcggccgcgaggcgttgccgttcggccgtgcgattcgcagcgtgcgcgacctgctcgacctgctgctgacgggctgtgcgaccgagcctgcggcaaaccgtcccacgtttacgctggcttgacggatatcaagacgatgaaaagaccctacgaggaaaatgggaaccattctttggggtccgtaccatgcataaaacgattcgaacttgtgtcaccgctgccgccgttgcggccagtttcgccgcgatgccttcgctgtcgcacgcggcctcgccgggcgacggcatcaaccagggcgacgtcctggtccggctgcgtgcgatcagcatccagccgaacgaacgcgcgagcgacacgctgggcgcgctcaacgtcggcgtgaacaacgcgatcgtgcccgagctcgacttcacgtacatgatccgcgactacctcggcgtcgaactgattctcggcacgtcgcggcaccagctgacgtcgagcctcggcaatctcggcggcgtgggcgtgctgccgccgacgctgctgctgcagtatcacttcaaccatgccggcaaggtgcgtccgtatttcggcgcgggcgtgaactacacgtacttctacaacaacgggctcaacgtcggcgggcagggcgtgtcgatcaacaagagcagcttcggcccggcattgcagttcggcgtggacgtgcagttgacgaagaaggtcttcatgaacgtcgacgtgaagaagatctggatgagcaccgatgcgacgctcggcgacaagggcatcggcacgctgcacatcgatccgctgatcgtcggcgtgggcgtcgggatgaagttctagacgcggcgggaaaggacaggaacagaaacagaacagagttggggttggcggcatggcggtctgcatgccgcttttttgcgcggcggatttacagcttgtcgtactggaagcgcatcgcggtgccttcgcgctggatgcgctcccacaccgcgcgcttttcgtcgtcgctcaggaacacccagttcgacacttcggccgccgtgcggccgcagccctgcagacttcgtcgaagagggtcgagcacacgccgatgcaggggctgtcgggcaggtcgtggagattggaggccatcggaggggttcacgcagttgaatcgtcagccgccattttaatgcatcgcggccggtcggtcggacgggcgcggccggcatgccgtaccggtgcggcggcgtgacagtacggccgggttcgggcgcgaccgccgcacggctcgcgtccggccggcgaacgcggtttcgtcgccgcccgtctttcccggtggacagccgccgattacccgatagaattcccgggaacgtcccgctgcacgggccgcctgaccggccggcagcgggatatctgttccgtttgcgcgacaccggcatgattttttgtgacggggcgcgaatgatggtagttttcggggttttcgaggggcggcgcgccagaatgcgccgccatgacgaggcagacggcagccgggcaacgtgtccggccggagggagaacgggatgaaagcaaaggtagtgggccggttcgcagcgctcgcgctgtgcgtgggtgcatcggcggcagcggcgaaggatacgcagctcaatgtctataactggtcggactacattgcgaaggacacgatcccgaacttcgagaagcagacgggcgtcaaggttcgctacgacaactacgacagcgacgatacgctgcaggcgaagctgctgacgggcagctcgggctacgacatcgtcgtgccgaccagcaactacgcgggcaagcagatcgccgccggcatcttcgcgccgctcgacaagtcgaagctgccgaacctcaagtacctcgatccgcaactgatggcgctcgtcgccggcgcggacccgggcaacaagttctcggtgccctgggcgtacggcacgaccggtctcgcgtacaacctgacgaaggcgcagcaggcgctcggcaaggtgccgctcgacaactgggacatcctgttcaagccggaaaacatctcgaagctgaagacctgcggcgtgtcggtgctcgacgcgcccgaccagatgttcgcggcgacgctgcactacatcggcaaggatccgatgagcacgaacccggccgactacaaggccgcgatggaagtgctgaagaagatccgcccgtacatcacgcaattcaactcgtcgggctacatcaacgacctggtcggcggcgacatctgcttcgcgttcggctggtcgggcgacgtcgtgatcgcgaagcatcgcgcgatcgaggcgaagaagtcgtacaaggtcgagtactacattccgaagggcggcgcgccggtgtggttcgacgtgatggcgatcccgaaggacgcgaagaacaaggaagccgcgctggagtggatcaactacatcgaggatccgaaggtgcacgcggcgatcacgaacgcggtgtactacccgagcgccaacgccgaggcccgcaagtacgtgcggcccgacgtcgcgaacgacccggccgtctatccgccggccgacgtcgtgaagacgctgttcctgctcaagccgctgccgcctgaaatccagcgtctgcagacgcgtctgtggaccgagctgaagtcgggccgctgacgcgagccggcgttcccagcagtcatgaagcccctggtgccccggggctttgttcgttcaacgcaggagagatgcagcacatcatgaatagccagtcgggtgcgccggtcgcgggcgcaccgtcctccgtttcctcctccggcgccgatgcgcgcgccgagaactttgtccagatcgtcgacgtcgtcaagaaattcggcgacaccgaagccgtgcgcagcgtcaacctgaccgtgcgccagggcgagctgttcgcgctgctcggcagctcgggctgcggcaagtcgacgttgctgcggatgctcgcgggcctcgagacggtcacgtcgggcaagatcctgatcgacggcgaggacctcgcgcagatgccgccgtacaagcggcccgtgaacatgatgttccagtcgtatgcgctgttcccgcacatgtcggtcgagtcgaacgtcgcgttcggcctcaagcaggaaggcacgccgaaggccgagctgaaggagcgcgtggccgcggcgctcgaactcgtgcagatgaccaagtacgcgaagcgcaagccgcaccagctgtcgggcggccagcagcagcgcgtcgcgctcgcgcgctcgctggtcaagcgcccgaagctgctgctgctcgacgagccgatgtccgcgctcgacaagcagatccgccagcgcacgcagatcgagctcgtcaacatcctgaacaaggtcggcgtcacctgcatcatggtcacgcacgaccaggaagaagcgatgacgatggccaatcgcctcgcggtgatgagcgaaggccagatcgtgcagatcggctcgccgaacgaagtgtacgaatacccgaacagccgcttctcggccgaattcatcggctcgacgaacctgttcgaaggcgtgaccgtcgaggacgaacccgaccacgtgtacatcgaatcgccggagctgccgagccggttgtacgtgagccacgggatctcgggcccgctcgggatgccggtcacggtgtcggtgcgccccgagcggatcgcgctcacgcgcaagccgcccgaaggcgcgttcaactgggcacgcggccggatcggcaacgtcgcgtacatgggcggctattcgctgtatcacgtgaagctcgacggcggcaagacggtgatcgcgaacgtgtcgagcctcgcgatttcggagctcgacacgccgtcgctcggcgacgagatctacgtgcgctggagcgcgactgccggcgtggtgctgacgtcatgacctcgttcaagtccatgctctcgtggccggtgcggcgcttcaacctgacgggcgccacggcggtcgtggccggcccgttcacgtggctcgtgctgttcttcctcgtgccgttcgtgctggtcgtcaagatcagtttcgcggagctgcagctcggcatcccgccgtacacggagcttgcgtcgtacgccgacggcgtcgtgcacgtcgcgctgaacctgtcgcactacgcgttcctgttcacggacagcctgtatttcgcgacctacgtgaactcggtgtgggtggccgcgatcacgacgctgctgtgcctgctgatcggctatccgatggcgtactacatcgcgcgctcgaacccggcgacccgcaacctgctgatgatgggcgtgatgctgccgttctggacgtcgttcctgatccgcgtgtacgcgtggatcggcatcctgaagaacaacgggctgctgaacaacttcctgatgtggatcggcctcacgcatacgccgatcgagctgtatcgcaccaactacgcggtgtacatcgggatggtgtattcgtacctgccgttcctcgtgatgccgctgtacgcgcacctggtgaagatggacctgcgtctgctcgaggccgcgtacgacctcggcgcgaagccgtggaaggcgttcgtgcagatcacgctgccgctgtcgaagaacgggatcatcgcgggctgcctgctcgtgttcatcccggcggtgggcgagtacgtgattcccgagctgctcggcggcgcgaacacgctgatgatcggccgcgtgatgtggaacgagttcttcaacaacgcagactggccgatggcatcggccgtgacctgcgcgatggtgctgctgctgctcgtgccgatggcgatgttccagcacttccaggcgaaggagcagggaggccgtcgatgaagccgaatcgttacctgcagttcgcggcgctgtttgccggcttcgcgttcctgtacatcccgatcatcagcctgatcgtctattcgttcaacgagtcgaagctcgtcaccgtgtggtcggggttctcgttccgctggtactcggcgctcgtcgaggacgacgagctgctgacggccgcgtggctgtcgctgaagatcggcgtgctgaccgcgttcgcgtcggtgatcatcggcacctgggccggtttcgtgctcgcgcggatggggcgttttcgcggtttcgcgctgttcagcgggatgatcaacgcgccgctcgtgattcccgaggtgatccaggggatctcgctgctgctgctgttcatcgaactggcgaagtggatcggctggccggccgagcgcggcatcttcacgatctggctcggccacgtgatgctgtgcatctcgtacgtcgcgatcatcgtgcagtcgcgcgtgcgcgagctgaacccgtcgctggaagaggccgcgctcgatctcggcgcgacgccgctgaaggtgttcttcacgatcacgctgccgctgatctcgcaggcgctgatcgcgggctggctgctgtcgttcacgctgtcgatcgacgacctcgtgctgtctgcgttcctgtcgggccccggctcgacgacgctgccgctcgtggtgttctcgcgtgtgcgcctcgggctgaacccggagatgaacgcgctcgcgacgctgttcatcgtcgcggtgacggccggcgtcgtgatcgcgaacttcgtgatgctgcgccaggagcgcaagcggatggcggggttcgcgacctgacgcctgaatggcgtctgccatgaacaacgcccggtgccgacgacgagtcgggccgggcgttttgtctggcgcgacgggagaaaggaattgaagatttcagaattgcttggtgcaagcctgactgccgcgatcgtggcaggcttgttgatcggcattgtgtccgtcaaggatttcggcgaagtttcgatcttttttccgctgtggctttcacggttgcatttcccgtggcaatgctgctttcgtatccggtctatcgggccagcacgctgcttcctcggagggcggtattgccgatgctggtcatcgtgggcggtgcggctggattgaccgttcttgcggttctgacacaggcagcctggccggacatcgcagggaacggagaaatggccctgctgtatgcggcaatcggaatgatgtgtgcggtttcggcgctggggtatgtcgagcgatccgggattgccggcaggctgcgcaaatggctcaaacggccgaattgacggccatccagcatctgtcttgacgacggggcgtcgcgccgttggccggtggcgcccgcgataaaaacgcccggtatcggcgtcgagtcggccgggcgttttgtctggtggcgctgcgcgtcgatcggcgccggtcggtacgcgattacgcgccgaacgccgccttcgccagcagcccgagcgctacgcacacgagcacggccgcgaacccggcctgcacgtgccgcgcggcgaggtgtctcgatgcgccgcgaccggcagccatgccgagcgcggtcgcgacggtgaaccacagcgtcacgtcgagcggtgcacgtgtgcccgacacgagcgtcgcgaacacgccgccggtgccgaccagcgcgatcaccatcagcgatgtcgcgaccaccccatgcatcgacacgttcgtgaacttgcgcagcatcggcacgatcacgaagccgccgccgacgccgagcagccccgtcatcaggcccgtcatcgcgccggtcgacgccagcgccacaccgaccggccaggaccacacgagccggcccgtatcgggattcacgcggccgacgcacagcggcgacgcgtcggcgtcgaccgccgcatgccgcagcgcctgccgcaacaggcggccggcgacgaccagcatcgtcagtgcgaacagcgcgagcagcaggcgctgcggcaacacatgcgcgagccgtacgccgagcgtggtcagcggcacgccggccacggccatcagcaatgccgcgcggtagcgcacgagcccgcggcggaagccttcgagcgcgccgagcgccgcgctgccggccaccgcgacgagcgcgacgggcgtggcctgctgcatcggccagctcatgccgacgacgagcgcgggcaccgcgaggatgccgccgccggcgccggtcaggccgagcacggcgccgacgaaaccgcccagtacgagggaaatcagcatgacgtcatcgggctccggtcaacgcgcgatcgcgggtttcgcgagccattcgcggcccttgagcatcgccttccagtagagcggcggcagcacgcgttccttgagcagccacgcgagccgcgacgggcgcttgccgtcgatcagccacgcggggaaggtcggcacgaccttgccgccgtacaggaattcggcgagcacgatcttgccgcgctcgacggtgagcgggcacgagccgtagccgtcgtatgcggcgtcgccgtgcgcgcggccgagcgacgcgagcaggttgtgcgcgacgacgggcgcctgcttgcgggcggccgcggccgttttcgcattggtcgtgttggtggcgtcgccgagcgcgtagatgtccgggtactgccgatggcgcagtgtcgccggatcgacgtcgatccagccggccgcatcggcgagcgggctcgaccgcacgaaatcgggcgccttctgcggcggcacgacgtggatcatgtcgaacgagcgcaccacggtttccttgccgccgtcgggcagcgcgcgcgcgaacgtcgcctggcgtgccgggccgtcgatcgagacgaggttgtggccgaacgacaacgcgatgtcgtagcttttcacgtactccatcagcgcgggtacgtagtcggcgacgccgaacagcgcgccgcccgcattcaggaactcgacgttcgcggcctcgaggcggcccgcgcgccgccagtggtcgcacgacaggtacatcgctttctgcggtgcgcctgcgcacttgatcggcatcggcggctgcgtgaagagcgcgttgccgccgcggaacgcgcgcacgagttcccacgtgtacggcgccaggtcgtaacggtagttggacgtgacgccgttgcggccgagcgtgtcggcgaggccttcgatcgcgtgccagtcgagcttgagccccgggcacacgacgagcttgcgatagccgatgcggcggcagccgtcgagcacgacggcgtgcgcgtcgggctcgaagcccgcgacggcggcctggatccggtgcacgccgcgcggcagcacgtcggtgatccggcgtgcggtggtctcgggcggaacacgcccgcgccgaccatcgtccagcccggctggtagtagtggacgtcggccggatcgatcaccgcgatgtcgagcgacgcgtcgcgcgcgagcaggctcgacgcgaccgcgatgccggccgcgcccgcgccgacgatcacgatgtcgtgccgcgcgtcgacggccggtgccgcctgcttgccgccttgcacgacacgcgacgcgagcgcgtgcaggtcgtagccggccgcggcggccgtcgcgacgatgtcgttcagcgggcgcaggccggcttgcgacaacgcccacagcgtggccgaacgcatgccgctgcggcagtacgcgagcaccgggccgtcgatcgacgcgacgagtgcgccgaattgcgcggcctggtcgtcggttaccttgcccgtatcgaccggcaggtaaagcacgtcgatgccgagcggcgcggcggccgcgcggatttcggcgacggtcggctggtcggggccttcgccgtcggggcggttgcagatgatcgcgcggatgccggctgcttgaagcgcgggcaggtcggccgtcacgatctgcggcgagaccgacagcgcgtcggtcagcttgcggatggaggtcatgtcggggtctcggttggggcgccggcgctcagatcgcgtcgagcgggatcttcaggtagcgcacgccgttgtcttcgggctcgggcaggtggccggcgcgcatgttgacctgcacggacggcagcatcagcacgggcatggcgagcgtggcgtcgcgcgtggtacgcatcgcgacgaaatcgtcctcggtcacgccgtccttcacgtgcacgttcgcgcggcgctgctcggccacggtcgtcacgaactgcacgtcgcggccgcccggctggtagtcgtggcacaggtacaggcgcgtgtcgggcggcaggccgagcacgcgcgcgatcgagcggtacagcgtgcgtgcatcgccgcccgggaagtcgcagcgggccgtgccgtagtcgggcatgaacagcgtgtcgccgacgaatgccgcgcgctgcgtcgcgtcgtcgacgcagtaggtcatgcaggcgggcgtgtggcccggcgtatgcagcgcacggatcgtcagcgtgccgagcgcgagcgtgtcgccgtcgtcgagcagccggtcgaactggcggccgtcctgcgcgaagccggcgcccgcgttgaacagcgtgccgaacacgtgctgcacgcggcgcacgtgcgaaccgatcgcgatccggccgccgacgtgttccttcaggtacggcgcggccgacaggtggtcggcgtgcacgtgggtttccagcagccagtgcacgtccgcgccgagttcggcgacgcgggcgatcagccggtcggcgctggcggtgcgcgtgcgcccggatgtcgggtcgtagtcgagcacgctgtcgatcagcgcgcatgcgcggctcgcggtatcgagcacgagatagctgacggtgtgggtcgccgggtcgaaaaagccttcgaccgacagcgtggtggcatcgctcacggggtgtccttgatcgggttctgcatctgcaatcgcgatctgtaactcaagaagcgtgccagcctgcgtcgcggcaccggccgatctgccagggatttgattcgacgcgggttttcggcgcaggcgcggcgaagcacgggcgtcgccggcgttcggttgccgctgccgactgccacttctggcagtgtcgtggcagaattggcagtccgcctggcagtgcacctgccagttcgtcaggcatctccttcaccgagcgtccgcatgaatccgcacgacaccatcccgatcgtccccgcgccgcgccccgacgtcatgcccgacgtgcgcgcgctcgtcgcgtatctcgagcaggatccgcagccgatgatcgtcgtcgatcccgattaccgcatcctcgcggcgaacgatgcgtaccggcgccagttcggcgttgcgggcgtcgagcacgtgggccggcactgtttccaggtgtcgcatcactacgatgtgccgtgcgaccaggccggcgagcattgcccgatgaagcaggcgctcgagtcgcgcgggctgaaccgcgtgctgcacatccatcacacgccgcgcggccccgaacacgtcgacgtcgaattgcggccgatcttcgatgcgcacggcaacgtgatcgcgtacgtcgagcggctgaccacggtgcgcagcgcatccgcgcagccgagtgcggaagggctcgtcggcggcgccgacgcgttcaatgcggcgctcggcgcactgcagcgcgtcgcgccgtcgatgctgccggtgctgctgctcggcgaatcgggcaccggcaaggagctgttcgcccgcgcgctgcacgaggcgagcgatcgcgcgatggggccgttcgtcgtcgtcgattgctcggggatcgccgagacgctgttcgagagcgaactgttcggttacgagaagggcgcgttcacgggcgcgaaccagcgcaagccgggcctcgtcgagaccgcgcagggcggcacgctgtttctcgacgagatcggcgacgtcccgctgccgatgcaggtgaagctgctgcgcctgatcgagtcgggcacgttccgccgcgtcggcggcgtcgaggcgctgcgcgcggacttccggctggtcgcggcgacgcacaagccgctgcgcgagatgatcgacgacggccggttccggcaggatctctactaccggatcaacgcgtttccgattccgctgccggcgttgcgcgagcggcgcggggacgtcgcgctgctggccgaatcgatcctgcggcgaatcgcgaacgcgcgcgccggcgcgggcgagacgggcgcacggccgttcgcggcccggccgtttgtcctgaccgaacgcgcgcgcgcgtgtctcgatgcctatgcgtggccgggcaatatccgcgagctgcgcaacgtgctcgaacgcgcgtgcctgttcgcggacgacgggacgatccgggtcgaacacctgccggccgagctggtcgccgcatcggcggcgccgcaggaccgcgcggccgatgcgcgcggcgtgtcggacgcggagctcgtgcgcatcgcgcgcacgttcgacggcacgcgcaaggcgctcgccgagcaggtcgggatgagcgagcggacgttgtaccggcggatgaaggcgctcgggctcggggcgcgcgagcgctgaacgggcaggcggcgggcgactggcagaggcacgcggctgtgtcgataatggcgcgttcgatcctgcttccacctcgccgatgaagagacgctccctttcgccttgcctgtttcttgccgccactgcgctgtgcaacctggcgcaggccgccaccgaatacacgtggaccgatgcggccggcgcacatgcggtgacgatcgtacgcaccgcgtccggcgacgacctcgagctcaaggtcgccgcgacgctcgacggccggcccgactggaccgtgcgcgactacgtgaaggcatgcccggtcgacgtgattctcgacgtcgtgcccgcgtcgatcgagatgcgcgacctgctcggcaacggccgcaagcagtttctgttcgcgtacaggatcggctgccgcggtgacgtcagcgccgaccaggtcaagtacttcctgatcgaccagggcacgaagtacgtgctgcgcggcgaggaaaccgtcacggtcaacggcaagttcatgggcggcggcgcggcgcccgtgccgaatgcggacctgaaagcccgacccgcgtttctgcgctacatgacgaagcactggcacgcgatcagcgcgcgcgactaccgataggcgcgcgctcggcgatcgtgacggcgcgtgcgacacgcgcctgctggggtgagtcgaacctgtcgaacaataagaaatcatggttcaacggcaattaattatcgttttacgataattttagacgtacaatcgacgctcgttcattcgtcgtcgaggacacgtcatgcattccgatcgcatcgcccgtatcagccagcagatggccaccgtcacgctgtggttcatcgtcggcatgctggtgctcaacgccgcgtgctgggcgttcccgtcactgaacgcggcgtcggggcccggcctcgtattcggcctcaccgattcggtgatctcgaacctgcacgtggatgtcgccgcgttcccgtggtggcagaaggcggtcggcatcctgctgtcgagcgtgccgctgatcgcgctcgcgaacggcctgcgtcatctgcgtgcgctgttccgcacctacgcgcgccgcgactatttctccgcgcaagcggccggccatctcggcaagacggggcgtgcgatcgggatgtgggtgttgctgagcctgctgtgcgaaccgctcctgagcgtgtgggcgacgctgcgcgaaccggtcggccatcgcgtggtcagcatcgggttcagcctgccgtacgtggtcgcgctgttcaccgcggcctgcatcgcggtcatcgcgcacatcctccggcaggcgagcgaactcgatgccgaacatcggcagttcgtctgaggcgcgccatgtcgatcgtggtcaagctcgatgtgatgctcgcgacgcgcaaggtccgctcgaaggatctcgcggcggcggtcggcatcaccgaacagaatctgtcgctgctcaagcaagggaaggtcaagggcatccgtttcgcgacgctcgaggcgatctgccgttatctcgactgccagcccggcgacctgctcgcgttcagcgatgacggtgtcggcgagccggactgacgcatcgccatcgcggcttgccggcgttgcggggcgacgccggtcgcgcatcgtcgcgctggctgtcgtcgcgtccgtatcgattcacctgctcggatggttcgtgctgcagcgggcgtcgacggtggtcggcccgaacgccggggcgcggccccggctcgcgctgcgcgtcgagctgattcccgcgcggccggtgcccgcggcgggcgcgcatgacgccgggcgaaccgggcccgccgcgagtgggcgcggtgcggagggcgccatgtcatcgacgaaacgatccgccgcggttgcggtgtcgcgcatgacgacgcgggcgtcttcgaatacggagggcgtttcgcgtcggcaaggtgaaacgcctgccggcgcaatcgcgacccgacgtgaacaccattccgagaacgcaccaggccccgatctcgactggcgccgcgatctggacgcgatcggctcgcggcatgcggcggcgcgcagtccggcgcaggcggcggtcggggcattgggcgcgtcgtccggcggcgtggccgcgcgccgtgacactgtcgatgcgaggctggccgacggcatgtcgaatgcccgtcgcaccgactgccggcacgcgtattcacgcgcgggcctgctggcgttgccgatgctcgcgctggatgcggtgcgcgacacgggctgcaaatggtgaagcgggcggcacgcgggaaacccgcctgtcgcccgcaccttcatgcgctcaacgcgttcagcgcgcgggcgcaagctgcgccatcgcctcccgcacgaaaccgatcagcgtgtcgtcgacccacgtatcctgcgtcagtgcaggctcgttcatcatcgccgcgcggaatttcgcatgcgtggccggatcgtggccggcatagctgcagaacagctcgagccagcgctgcgcgagcgcgcggccttccggcgaagcaggtcgggcgcccgcatcgatcgcgtcgcgcacgtcgcccatcagttgcggccattccatcgcgcgttcgccgtagtgcgcgcgcatgaagcggatctcgtccggcgcgaggtacttctcgaagatccgcatcttgttttcggacgacgcacgcagcacatagtcgcgcagcgcggtcgaaatgccgatcttcgactgcatcgccggttcttgctcgtgcatcaggttcagctttgccagcagccgcgggtcgttgttcgtgtcgcgcacgagcagcttcatccagcgactggcgagcgcacgggggcgttcgtcctcggcgggtacgcccgcgtcgtgcagcgcgcgcacttcgtcgacgagtgcgatccattcggcgtcgcccgcctggcttttctggtacatcggcaggcgcgcgagttcttcctcggaaaaatatttgtcgtacacggtcatcaactccagtgtggtgagccaatcggccagctccggctccgtgcccgcggcgagctgcgcatgcaggctcacgaggcgctcgcgcagctgcgcggtctgcgcgagctgacggtcgagcagcgcgatctgcttcgcgacgagatcgacgagcggagtgccgggccggttcaggtgatcgccgatttcggtgagcgacaggccgaagcgacgcaacgcctggatctggtgaagccgggcgatgtcgtggcggtcgtacagccggtagccgttgtcggcgcgcgccgaaggcgtcagcagaccgatcgcgtgatagtgatgaagcgtgcggacggtcagcccgctgcgtttcgccagttctcccactttcagtcgcattcgttcctccgttcggtacgcacactggagtctcgaacgttacgctacgtgagggtcaagcggaagatggggaggcgtgcgcgcggggattccgcgcgcacgcgatggcgggccggcttattgcggcgaaggtggcgaaggcggcgtgtcggtggcggcggtatcggcagtggcggcgcgcgcttgctggccggttgcgccgtcgcctgcggcgttggcggcattgccggacggcccgcccttgtcgaccggcggcgtgcccatcgcctggtagagccgcgcggtatccgcgaaccgcgcgccggtcgcgcggatctcgtcgagccgtgcattgcgatactgcagctcgctggcgcgcgcggccgacggcggcagcgcgccgagccgcacgcgggccgccgcgtcgtcgtacgcgccccgcgcggacagcgcggcgcgcgacgacgcgtcgagcgcttccgcatcgtgctcgagcgccgcgagcgaatcggcgacgttctggaacgcgccgagcacggcctgcttgtactggtcgacggcggcctcgtaagtcgccttcgccgcgcggcgctgggcgagcagcgcgccgccgtggaagatcggctggctcagcgacgcgccgacgttccagatcgcgccggcgcccgacagcatcgccggccagctgaagccgcctttgcccatcgcggccgacagcgacagctgcgggaacatctgcgcggtcgcgaggccgacttcggccgcggccgccttcagccccgcgtcggcggcctggatgtccgggcggctttgcagcaggtcagacggcacgacgacgggcacctgttcgggcaggtgcagatcggcgagcgtgagatcggccggcggccggtcgggcgtgcggccgaccagcaccgcgagcgcatggcgggccgagtcgcgctgctggcgcagcgcgggcaggctcgccgcgaacgtgtcggcgctttgccgcgcgttcagcgcgtcgctgcgcgaggcggaaccgagtgcgtagcggcgttcggcatcgtgcgcctggtcgttggcgagggcgacgagccgctcggtcgtgtcgatctgcgcattcagcaccgacaccgtgatcgacgcggtgacgatgttcgcggccagcgcgcgccgcgcggattcgagctggaacgcgctgacgtcgacgcgtcgcgccagcgcgcggttcgcgaaacgcgacgcgccgaacaggtcgatcgtgtagctcgcctgcagctggccgacgaacgtgtcgtacagcagcgtcggcgcgccgagcgcggggatcggcacgccgagcgcacgctggcgcgcggcctggccgctcgcgtcgatcgacggcagcatcgagctgccgatctgcccgcgcagctgttcgcgtgcggcatccagcgagtgcgatgccgcactgagcgtcgggctgttgcgcagcccttcgtcgacgagcgcgttcagcgcatcggagcggtactgcttccaccagtcgggcaccggctgtgcgccgacctcgaactgctgcgcgacgccttgcgcggacacggtctgctgcacttgcggcgtggtgccgtagtgcgcgggcgacggcatcgcgggcggctcgccgctcggcgcgaaccaggcgcagcccgcgagcgggccggcgaggctcgccacggcgagggcccgcacggctttcgttttcaggttcatcgatcgatccatggtcaggctcccgacggcgcggccggcgtgctgccgccggacggcgggccgttctgcgggtcgcgttcgtcgcgcttcacgcggaaccacgtcgcatacagcgcgggcaggtagaacagcgtcagcacggtcgcgctcgtgatgccgcccatcagcgcggtcgccatcggcccgaagaagttcgagcgcaacagcgggatcagcgcgagcacggcggccgcggccgtcagcgtgatcgggcggaaccgccgcacggtcgcgccgatgatcgcgtcgacgcggccgtggccggcggcgatgtcctgctcgatctggtcgacgaggatcaccgagttgcgcatgatgatcccgaacatcgcgatcacgccgagcatcgcgacgaagccgaacggctggccgaacatcagcagcgtggcgaccacgccgatcagcccgagcggtgcggtcagcacgaccatcagcacgcgcgagaagctctgcagctggatcatcagcagcgtgaacaccgcgatcgccatcagcggcatctgcgcattgatcgatttctgcgccttcgcgctttcctcgaccgagccgccgatgttgatctggtagccgaccggcaattgcgcgcgcaatgcgttcagtttcgcgtcgaccgcatgcgtgacgtcgatgccctgcgcgccggcgcgtacgtccgactgcacggtgatggtcggctggcggtcgcgctcccacacgacgccgtattcgagcgtcggcttgaagcggccgagcgagccgagcggcaccgggccgttcggggtcggcagcgcgaggccggcgagcttcgcggggtcgacgcgatcggccttcggcgcgcgcaggtcgaccgcgatcagcttgtcgcgttcgcggtactgcgtgacggtcgtgccggacagcgtcatcgcgaggaagctcgagacgtcctgcgacgtgacgttcagttcacgcgccttcttctggtcgatctcgaagcgcaccgagcgctcggccggctcgtcccagtcgaactgcacgttgaccgtgcgcgcgtcgccgcgcatcgtcgccgcgaccttctcggcgatcgagcggaccgtcgcgatgctgtcgccgctcacgcggaactgcaccgggtagccgaccggcgggccgttctcgagccgcgacagccgccagcgcacggccgggaactgctcgcgcagcgtggtttcgagccaggtcgcgagcttctcgcgatccttcaccgatttcgcggtgatcacgaactgcgcgaagttcggcaactgaagctgctggtcgagcggcaggtagaagcgcggtgcgccgctgccgacgaagctcaccgaatgatcgatctcggggcgcttgtcgatcactttctcgaggcgctcggtctcgcgcagcgtcgccgcgaacgacgcgccttcgggcagccgcaggtcgacgagcagctcggggcgatcggaactcgggaagaactgctgcggcacgagcgaaaagcccatcattgccacgacgaacagggcgcccgtgatcagcagcacgacgaagcgccgctcgatgcaccagtcgatccagccgcgcaggcggcggtagaagcgcgtgtcgtagatgtcgtgctcgtgatcgtcgggcaggtgcgcctcgtgcgcgtgccgcttgcgctcgggcagcatgtggtagccgagcagcggaatcagcacgacggccgcgaaccacgacgcgatcagcgcgatggccgacacctcgaagatcgagcgcgtgtattcgccggtgctcgatttcgcgagcgcgatcggcaggaagcccgacacggttacgagcgtgccggtcagcatcgggaacgcggtgctcgtataggcgaacgcggcggcgcgtgcgcgggtgtagccctgttcgagcttcacggccatcatctcgaccgcgatgatcgcgtcgtcgacgagcagcccgagcgcgagcacgagcgtgccgagcgacaccttgtgcagcccgatgtcgaacaggtacatgaagagggcggtgaccgcgagcacgaccggaatcgagatcacgaccaccattccggtgcgcaggccgagcgacacgaggctcacgaccagcacgatcgcgaccgcttcggcgacggcttcgaggaaatcgtcgaccgaatgcgcgaccgcgtgcggcatgctcgacacctcgaccagcttgaggccggccggcagttgcgcctgcaggtccttcgattcggcgtcgagcgccttgccgagccggatcacgtcgccgcccggctgcatcgtcacgccgatgccgagcacggccttgccggccgcgcctgagccggccgcacctgagccgcccgctcgcatctgcgtgacgaccgggtcgtcgtagccgcgcttcacggtcgcgagatcgccgagccggaacgtgcggccgttgatgcggatcagcgtatcggcgatcgcatcgacattgtcgaactggccgctcgggcgcacgaacacgcgatcgtcggcggtcgtcagcacgccggccgacgagatgtcgttctgcgcgttgatggcctggccgagctgctgcggcgagatgccgaggcgcgtgagctgcacgttgttcacctcgatgaagatccgctggtcggggtcgccgaaatagtcgaccttgccgacgcccggcacgcgcagcagcacggtgcgcaactgatcggcgtagtcgtgcagttgtgcgggcgtgaagccgtcgccctcgagcgtccagatgttggtgtagacgtcgccgaattcgtcgttgaagaacgggccctgcacgccgggcggcagcgtatagccgatgtcgccgaccttcttgcggatctggtaccaggtctcgggcacgtccttcacgggcgccgaatccttcatcgtgaagaagatcagcgattcgccggggcgcgaatagctgcgcaggaagtcgatggccggcgtttcctgcagcttgcggccgatccggtcggtcacctgttcctgcacctgccgcgcggtcgcgccgggccagaacgtgcggatcaccatcacgcggaacgtgaacggcgggtcttcggactgcgcgagccgcgtgtacgcgaggatgcccgcgagcgtcgcgagcgcgatcaggtagacgaccagcgcctggtggcgcagcgcccacgcggagagattgaagcggccttcttcgtacgaaacgctcacgatgcgaagtcctccggatgcagcggcgcgatcgcgcgtaccttctcgcccgcgctgaccgtgtgcacgccctgcaacacgacgcgctcgccgggctgcagcccgtgcgacaccgtcaccgtgcgctcgttgaagcgcgcgacgtcgacgcggcgcagctcgagcgtgtcgtccttcgtgcgcacgacccacacggccggctgcgcgccgtcgtggaacagcgcggtcgcgggcagcgtgatcgacggcgcgtcgccggcggccggtgcgccgtcgaacgcgacgctggccgtcatcccgagccggatcgccggatcgggcgcggcgagcgtgagcttcacgcgatacgtgcggctttgcggatcggcggccggcgcgatttcgcgcaccttcgcggcgaactggcgaccgggcagcgacggcagcgtgacgctggccgcgtggccgggcgtgagcgacgcaagcgcggcttcgggcacgtcgctgacgacgtcgacgtcgccggaccacgcgagctggtagacgggctggccggccgacacgttctggccggtgtcggcctgttcggcggtgatgtagcccgcgtgatcggcgacgagcgtcgcgtagcgaagctggttccgggcgagcgcgagctgctgctgcgcctggtcgcgctgcgcgagcgccgacgtgtagctgttctcggtctgttcgagctgggcggtcgcgatcaggttttcgcgcgcctgtgcgcggtcgcggtcgagctgctgcttcgcgaacgcgaggctgtgcgtcgcggcgtcgagttgcgcctgtgcgctcgcggcgttcttctcgacgtcggacggatcgagcagcgcgacgacctggccgaccttgaccgtatcgccgaggcgcaccttgcgctcgatgatcttgccggcgatgcggaacgacagagggtggcataacgcggctggatctcgccggggagcgtgcgggcgaccgcggcgtcgtcggcatgggcgggcagtgcgacgacggggcgcggggcgggcggcgcggattctttgggatgacaggcggcgaggacgagcgcggtgccgatcagcagcacggcgcgggaaccggagcgattcacgaaacccccaagtgaggtgagagcgagagcggaacgaagccggcaagcgcggcgcgcgcttgccccgagcggcgccgacaggggcgcgcggacagcattttcagaaactgtggcgaattctaatacacacctgtatctgagtgcaaagatgaatttgaaagggaatcgatgctagactgcgcgccatgaaaccacagcgcttaacccgcgagcagagcagggatcagacgcgcgaacgtctgctgaatgccgcacatcgcatttttctgaagaaaggttttgtggccgcgagcgtcgaggacatcgcggccgcggccggctatacgcgcggcgcgttctactcgaatttccgcagcaagtcggaactcctgctggagttgctggagcgcaaccatgcgcaggtgcaggccgatttccaggcgatcttcgacgagggcgggtcgcgcgaacagatggaatcgatgacgctcgcgcattaccgcacgctgttcgccgacgacgaattctcgttgctgtggggcgaggcgaagctgcaggccgcgcgcgacgcgaagttccgcgtgcgcttcaaccagttcctgcacgccaagcgcgtgcagatggccgaattcatccggcgcttctccgagcgctccggcacgccgctgctgttgccggcggagacgctcgcgttcgggctgatgtgcctgtgcgacggcgtgcagtcgtattacgcggccgatccgcagcacgtgccggccgaggtggccgagtcggtgctcgcgggattcttcgcgcgtgtcgtgctcgggcgtgcgccggactgacgcggcagcggattcgtcgtgccgcgtgcgatgcgcggcaaaggcggggtgcgatgaagcatgcggcatgcgcggcgcctcatcgcgttgtgcgaatcagcgctcgccggtcatccgccggtacgcgtcgagcagcgacgtcttgtagacgacgcccgcgagcgtcggctcggcttcgctttcgatcaccggcaggcgttcgccctggaacgccatgaagcgttcgagcgcggtggcgagcggcatgtcgggcgtcaggagcggaaacggcgtgtgcgcgtaatgcgcggccgtcttgtcggtcgtgtcgcgcttgtcgagcaggtccgacgtgatgtccttcagcgcgaccgcgccgcgaaagcgcccggcatcatcggtgacgtacaggtacttcaccggatattcgagaaacacgcgcgtcatgtcggcgacgctcgccgtgagcggcacgaccgtctgcgcgggctggatcagctcgcgcatctgcgtggtgcgcaggcgcagcttctcctgcgcgtcctggtaatggtgctgcgtgatttcgtacatcgacgtcgtgccggtcgcgcgcgcgacgaaatacgcgaatacgcacgacaccagcagcggcaacacgacctgatagctcagcgtcatctcgaagatcatcaggatcgccatcagcggcgcctgcgtggcgcccgccatgaacgcgcccatcccgacgatcgcgtacgcgaagtacgccgacgtatggccgggccacagcgcttccatcgcgagcccgaacagcgaaccgaacaccgcgccgacgaacagcgtcggcgtgaacacgccgccgatcgcacccgagccgaccgtggcggaggttgcgatgaccttgaacacgagcaccgcgaccagcgcctgccaggtccacggcgaatgcaggatctggttgacgacgctatagccgttgccccatacgtccggcgtccaaaccgagatcacgccgacgacgaggccgccgagcgcgagccgcaccggcagcggcaccggcagccgcttgaaatggtgcttcgacgcgtcgagcaggtgcaggaactgcggcgcgagcacgccgcacagcgcgccgagcacgacgaacagcagcacctcggggccggtgacggccggaaacaccggcatctcgtacggcggccgataaccggcgaattcgcgcatcacgatgttcgcgacgaccgacgcgacgaccatcgggccgaagctctccatcgcgatcgtgccgagcacgatttccgacacgaagaatgcgccggcgatcggcgcgttgtaggcggacgtgatgccggccgccgccccgcaggcgaccagcaggcgcaggcgcggcgggtcgaagtgcacgaagcggccgacgagcgacgcggcgagcgccgcgagctgcaccatcgggccttcgcggccgatcgagccgccgctgccgatcgtcagcagcgacgacacgctgcgccacaggctctgccgtaccggcacgacgccgttgccgagcgcgaccgattccatgtagtcggtattgcccgccttcttgtcgccgcgcgtcgcgagcagcagcacgcagccggcgaggaagccacccgcggccggcatccagaaccgcacgtaccacggcaggcgtttcgccatctgcacgaagctgccgctttgcccggagatcaggtgctgcatcaggtcgatgccttcgcggaacgccatcgtcgcaaaggcgccgccgacgccgacgatggccgaccagatcagcatcgtatgggcgtccgacaggcggaacagcgtttgggcgcgagtgcgcagcttcagcaggaacgagagcacggctgaaagagggcgatggaaaacgacgcgaagcatagcactgcgccgcgcccgcgggaccttcccggcgggcgcggcgcgcgacgtgtcacgggcgggcaactcagccaagccagtgctgcacggcccaggtgatcccgtagccgccggcgatcagccacacgtacaggatcaggccggtcatcagcgcgcgcgggccggctgcgcggatctgcgccacgcgggtttcgatgccgagcgcggtcatggccatcgtcagtgcgaaggtgtcgagcacgttcagcgtgtgcgtgacgtccgtcggcagcacgttcaccgagttgacgatcacgaagccgaggaacccgagcgcgaaccagggcacggccaccttgcgcttgccttgcgcgccgccggcggtggcgcgggccgagcgggcgagccaccagccgagcaccagcagcaccggcaccagcagcatcacgcgcgtcatcttgacgatcgtcgcgatgtgcgcgacctgcgggctgatgtcgctcgccgcgccgaccacctgagcgacctcgtggatcgtgccgccgaagaacaggcccaggccggccgggtcgagattcagcagaccggcgtgataggcgatcgggtacaggaacatcgacagcgtgccgaacagcacgacgctgcccacggccatcgcgctctggtgcggcttcgactgcagcgtcgactcgaacgcgagcacggcggccgcgccgcagatcgcgctgccggcggcggtcagcagcgcggaatcgcggtcgagcttcatcagcttcatgccggcccaggtgccgatcgcgagcgtgctgacgacgacgaggaccgacaccgtcaggcccggcagcccgacctgcgcgatttcctgcaggctcacgcgcaacccgaagaacgcgaccgcgatgcgcagcagcttgcgcgcggagaagttgacgccggccgcccagctcgccggcatgccgtcgcgcagcgcgttgccgtacagcgcgccggcgacgatgccgacgatcagcggcgacaggccgagccccgcgatcgcgggaagctgggacaggctcgtgacggcggcggcgaacagcgcgacgaacagcacgccgttcaactggccgcgcatcgacggcgcggcggggctgagatggggagtcggggcagtggacatggaagcaccgtgatggagcgtgttgcgatgctgtaatcctaattttgttatatcgatatgaaaaattgtgatttgtgacgtaaactatccggaaagccgataatttatccccatgaccccggatcaactgataacgttcgccgccgtcgccgaacacctgaacatcagccacgccgccgtggcgctgcatctgtcgcagccggccgtgtcgggccagttgcggctgctgcaggacgaattcggcgagccgctgtaccagcgcgaaggccgcggcatccgcctgaccccggtcggcgaacagctcgcgcagtacgcgaaagcgcagcgcgatacgttcgcgcaggcgcgcgcgtttcgcgacgcggtgcgcggcctggaagccggcacgctgcgcatcggcgcgagcacgacacccgcgagctacctgttgccttatctgatctcggcgttccagccgcgcgcgcgcgtggcgatccacacgatgagcggcaacacggccgacgtggtcgcggcgctgccgtcgctcgacatcgcgatgatcgaagggccgcccggcgaggcgctgccgccgggcaccgcggtgcacgcgtggcgcgaggacgagatcgtggcgatcgtgccgaccgggcatccgctggccgcgcccgaatacgcgccgggcgtcacgctcgacgcgctggcggcccatccgctcgtcctgcgcgaggcgggctccgccgtgcggcaactcgtcgagcgcgcgttcgcgcaaggcgcggcgccgatgcgtgtcgcattcgagatcgcgggtgtcgaggccgtgaaggaagccgtgcgtgccgggatgggcgtcgggttcgtgtccgcgatgtcgctgcgtcacgacgatgccgcgctcgtcctgcgctcgctcgcgcccgcgccgctcacgcgtcacttctccatcctcgtgccgcacggcggcgcgccgtcgcgggtcgccgcacaattcctcgaaatgagcctcgcgcacgatatcgcctgaacctcgccggaacggccgaagccggcccgggcatgcgtgatgcgtgccgtcgggcgcgcgttcgcgccatgccccaacttaggatttcctctatggcgtgggttcgaggcgaagcgcaccatccgtctcaagcatatggaaccggttccattccgggaaaaagagggcagaatgacagacatcgtgatcgtggcgagcgcattcgggatggaccgcgtgcgtcaggagggccacagcgcattcgtcgcgaccgcggcggcatcgggtgcgacgggtttcgaggtgcggcgcgaactgttcgcgtcggaagcggacgccgcgcccggcgcgctcgccgcgctgggtgcgctactggccggccacgggctgtggtcggtctattcgacgccggccaacctgtacacggaaacgggcgcgctcgatgcggacgcattgcgcggcgcgcttgcggaagccgacgcgctcggcgcgcgcttcgtgaaattccagctcggcggcttcgccggcgacgcgcacgcggccgacatcgtcgcgctgtcgcgcggcgcgaaggcccgcgtggtggtcgagaacggccagcttccggtcggcggcgcgctcgcgcagttccgcgggctgttcgatgcgttggccgccgcgggcatgcccgatgcgctcgggatgacgttcgacatcggcaactggcagtggccgggcgaagcgccgcttgattgcgcgcaagtgctcgcatcccatgtggaatacattcactgcaaggccgtcgagggcgagggcgcgcgccgtttcgccgccgcgccggcgccgaacgacccgctcgtgaccggcgtgctcgcggcgctgccgcagcaggcgccgcgcggcatcgagtttccgttcgacgcggccgacctggcgggcgatgcatgccggcgagtcgcgtggctcgcaaccgcgtgacggcagaaggatcctggagagttcattcatgaaagcagcactcgatgtcgtgacctacggcgaagcgatggcgatgttcgtcgcgaccgagcccggtcatctcgcgcatgcgacgcaattcgcgaagcggatcgcgggcgccgacctgaacgtcgcgatcggcctgtcgcggctcggcttccgggtcggctggatgagccgcgtcggccgcgattcgttcggcggctacgtgctcgacacgctggcgcgcgagggcatcgacgcatcgtgcgtgaccgtcgatccgcgctacccgaccggctttcagctcaagtcgcgcaacgacgacggcagcgacccgaccgtcgagtatttccgcaagggctcggccgcgagccacctgtcgtgcgacgactacgtggccgactacgtgctcggcgcgcgccacctgcacctgacgggcgtcgcgccggcgatctccgcgacgtcgtgcgagctcgcgttcaagctggcgcgcgaaatgcgcgcggccggcaagacgatctcgttcgacccgaacctgcgcccgacgctgtggccgtccgccgacgtgatggcgaagacgctgaacgcgctcgcgtcgctcgccgactgggtgctgccgggcatcgccgaagggcggcagctgaccgggcacgacacgccggccgatatcgcgggcttctatctcgcgcaaggtgcgcgcggggtggtgatcaagctcggtgccgaaggggcgtattaccggacggctgacggccgtgacggaacggtggcgggcgagcgtgtgcggaacgtcgtcgacacggtcggcgccggtgacggcttcgcggtcggcgtggtcagcgcgctgctggaagggaagacgatcgaacaggccgtggcgcgcggcaaccgcatcggcgcgcttgcgatccaggtgatcggcgactcggaagggctgccgacccgagccgcgctcgatcgattcgaaaacgtcaccaatcacgccgatcgcttagagaaaccttcaccgcgcaatgagaggccggacacggcacaatccgcggactcatttagtcgtgcatgtatgggatcggagtaggtgctgatgcgcgaactctggtcgaccgcgaagcatgggatcgggtaagggctaaagcgctaactctgatcgaccgcgaagcatgggatcggagtaagggctaaagcgctaactctgatcgaccgcgaagcatgggaccagagtaagtgctaaagcactaactctggtcgaccgcgaagcatgggatcagagtaagcgctaaagcgctaactctgatcgacacagagacattctgatggccaatacactcgctgcccgccgctggtggacgatcatgccgatcgtcttcatcacctacagcctcgcctacctcgaccgcgcgaactacgggttcgccgccgcagccggcatcaaccaggacctcgggatcagcaagggcctgtcgtcgctgatcggcgcgctgttcttcctcggctacttcttcttccagatccccggcgcaatctatgcggaacgccgcagcgtgaagaagctcgtgttcgtcagcctcatcctgtggggcgcctgcgcggcactcacgggcgtggtcagcaacatcccgtcgctgatggcgatccgcttcgtactcggtgtcgtcgaggcggccgtgatgccggcgatgctgatctacatcagcaactggttcacgaagaacgaacgctcgcgcgcgaacacgttcctgatcctcggcaacccggtcaccgtgctgtggatgtcgatcgtctcgggctatctcgtgcacgaattcggctggcgccacatgttcatcgccgaaggcgtgccggccgtcctctgggccgtgtgctggtggttcctcgtgcaggacaagccggccgattcgccgtggctcaacgcacaggaaaaacgcgacctcgacgccgcgctcgcggccgagcaggcggcgatcaagcccgtgcgcaactatggcgaggcattccgctcgccggccgtgatcaagctgtgcgcacagtatttctgctggagcatcggcgtgtacggcttcgtgctgtggctgccgtcgatcgtcaagaacggctccgacctcgggatggtcgcgaccggctggctgtccgcgctgccgtatctcgccgcgacgatcgcgatgctcgccgcgtcgtgggcgtccgacaaggtcggttcgcgccgtggcttcgtgtggccgttcctgctgatcggcgcggccgcgttcgccgcatcgtacgccctcggctcgtcgcatttctggatctcgtatgcgctgctggtcgtggccggtgccgccatgtacgcgccgtacggcccgttcttcgcgatcgtcccggaactgctgccgaagaacgtcgccggcggcgcgatggcgctgatcaacagcatgggcgcgctcggctcgttcgtcggctcgtacttcgtcggctacctgaacggagcgaccggctcgcccgtcgcgtcgtacgcgttcatgagcgccgcgctcgtcgccgcggtgatcctcacgctgtccgtcaaaccccaggcgcccgatacgcatccgctcgcggcgccgctgcaaggaaaatgaatcagatgaagccccgtatcgtcgcgtacaagccgctgcccgatgacgtcctcgcgtacctgcgcgagcatgcggacgtcgtgccgacggcgccgcagccctcgccgatgcgctcggcgacgcggacggcgcgatcggcgcgagcctgaaggtcacgccggacatgctcgaccgcgcaccgcggctgaaggcgtggtcgacgatttcggtcggctacgacaacttcgacgtcgcggatctcacgcggcgcgggatcgtgctcgcgcatacgccggacgtgctgaccgaatcgaccgccgatacggtgttctcgctgatcctcgcgtccgcgcgacgcgtggtcgagttggccgagtgggtgaaggcaggccactggcatcgcagcatcggccccgacctgtacggcaccgacgtgcagggcaagacgctcggcatcgtcgggctcgggcggatcggcggcgcggtcgcttccggatgcgggtgctgtacgcgaaccggtccgcgcatgtggaagccgaaacgcaatacggcgcacggcgcgtgacgctcgacgaactgctcgcgcaagcggatttcgtgtgcctgcaagtgccgctgtcgcccgaaacgcaccacctgatcggcgcggccgaattcgcgaagatgaaacgcggcgcgatcctgatcaatgcatcgcgcgggccggtggtcgacgaagccgcgctgatcgatgcgctgcgcgcgggtacgatccgcggcgcggggctcgacgtgttcgagaaggaaccgctggccgcggattcgccgctgctgcagatgaagaatgtcgtcgcgctgccgcatatcggctcggcgacgcacgagacgcgccacgcgatggcgcgctgcgccgcggaaaacctggtcggcgcgctggccggcacgctgcgcacgaatctcgtcaatccggatgcgctcgcacgcgcctgagccgcggcgggtaacgggccgaccgcgagcaggtgcccgcccggcggacgggcggcttcgttagagtcgatggtcttggtgccggagggctggctgcgttatgatccccgcgcgtcgtatcgacggcacggcagcgctgccggcggcgtctcgcgacgggtatccgcgccaggtccggtgcggccgactgcttgtgcacgtgaccggggcgggtgccgacgcgccggcgccgatcgaccgcgaagcatgggatccgcgcaagcggtgaagggcggacgctgatcgaccgcgaagcatgggatccgcgtaagcgctgagcgctaacgcggatcgacaggagattccaccgggtggcttacgtttccaacaacaaagatccgtctgctcacgacgcggcgcggatcgaacgtcgcgaggcacgacagtgaccgattcgcaaccaaccacaacgcgtccggcgacgatcagcgacgtcgcgcgcgaagccggcaccggcaaaaccagcgtgtcgcgctacctgaacggcgagacgcacgtgctgtccaccgatctgcgccagcggatcgaagcggcaatcgcgcggctcaactaccggccgaaccagatggcgcgcgggctcaagcgcggccgcaaccggctgctcggcatgctcgcagccgacctgaccaatcctataccgtcgaagtgctgcaaggcgtcgaggctgcctgccaggcgctcggctacatgccgctgatctgtcacgcggcgaacgaagtcgagatggagcgccgcttcctgcagctgctcacgacctaccgcgtcgaagggctgatcgtcaacgcgctcggcgccgatgaggacgtgctgcgcccgctgcgcggggccggcatcccggccgtgctcgtcgaccggaccgtcgagggcttcgaggccgacctgatcggcctcgacaacgccgacgcgatcgagacggcactcgcgcacctgatcgaacacggtttcgacgcaatccatttcgtcgtgcagccgttcgagcgcgtcagctcgcggcgcctgcgcgaggccgcattccgcgcggcactcggcgcgcgcgggctgacggtgccgtcgacggtcgtgctcgacctgaacgagcccgatgcgaccgcggcggcgttcgccgacatcgatgcccgcatcgacgacgcggcacggcgcggcgtgcgcgcggcgctgttcgccgcgaacgcgccggtcgcgctcgcgatcgcacgccacctgcgcgcgcgtttcggcgccgcatggcagcagaaggcggcgctgctgtcgatcgacgatccggaatgggccgagctgatcggtatcacgacgatccggcagccgacctacgaaatcggctacaaggccgtcgaattcgtgcacgagcggatcgacggcgcagcgggcgacgtacgcgtctcgctgttgcccggcgagctggttgcgcgcgcgtcgaccgcaagctgagtatcattcggggcacgcagcgcgtcaggtgcgctgccccgaacaaggaaatacatgactgtcgcccccgtcacgctggcggtgctgatcgccgccacgctgatcatcgcgctcctgccgctcgtcctcttccgtatcctgcgcaagccgcttgcgctgaaccgccgcgacacgatcgtcggcgtggccgtcttcacgctgttcgcgatgatcctcgaacgcgcattccacgggctcgtgctgagccagacgccgcccgacggctggctcacgcagccgctcgcgttcgtcgcgtacagcgcgcttgcgaccgccgtgtgaggaagtcggccgttatctcgggatgcgttgaaccgcgctacggccgcgttcggccggcgtcagccgcggaatcggctgggatcggcggcgcgaagcgtggttcgtcgccgtactcgtgtggggccagtggtcgtatctcgcgtggctcgcgagccgcggccagctcgagacccagctcgccgatctgccgggcgataccgtcgtgcggctgcacgtgatgctcgcgacgctgtcggcacagtcgatcctgctgttgctgctcgagcgctgcgcggcgttcgtgctgcagcttgcgctgtcggtgctggtctggcgcggcgtgcgcgccggccgcgcgggcgtgttgccgctcgcgatcgtgctgcatgcgctggcagccgcgccggcgctgctgtaccaggtgcgcgtgctgccggccggctgggtcgaggccgcgtatttcgtgctggccgcgcttctggtcgtcgtgctggtgaaggcgtgccggccgccgcaatcggcagcctgacgggagagacgggatggacgactatctgatcgaatgccagagcgcggaattcgacgcgctcgcacgcgtgatctgcgatctctttccggagcagacgcggttcgccgaaagcagcgacgcgcgcgggcggttcctgtccgtgcactggctcgcgatgcgtttcggcgcgacgccgaagcggatgacgctcgatatccgcatcgtgccggcggcactcgcgcgctatctggcgctcaagccgatgcagcgcgcgcgcagccatgcggtgctgcatgcgtatacggaagcgatgctcgggtcgctcgaggagcgccacgcggccggcgaggccgtcgagcgcgacgccgaactcgaactcgacgaagactttgcgtgatcgttcgcgccggcgcgatgccggcacgccgcgtcacgcgtcgcggtagacctgcgcgaagcgctgcgcctgcacgacaccggtcgcgtattgcatcacccagtcgccggcgacgccgcgcagcgtgtcgccgttttccgagcgggcgatcgtgaacggctcgtccatccggcgggcgagcaggacggccggccggttccggtaggcgcccggtgcgccgtgtgcgagtgccggatcggcgggcaggtatttggcgtcgaagcgcgcgcgacacgacccagcggtcgccggtcgagcccgtgatcagcgcgtcgcccgccacatagcggttcgggccttcgaggctcatcagttcgccgtcggcgtccgcgaaggaaacggcgacggtttcgtccttgacgacgcgacgggcctgcggatcggtacgcaggtcgatgtgcttgagttcgagcatggcgggaagtgcgggaaaagccgggagcttatcgaatccggcgcgccgtgtgacgcgccggtcgcctgtagcggtgccgttcggcccggacgggccgtgtgcggtgccggcggagccggcagggcgggcgtcagggctgcgcgggtgcgctggcagccggcgcggctgccgccttgccttccttgccctttgtcttgcccttgccacgatgctcgccgccgtggtgcagccagctgcggaacgtcgtgtcggccagtgccttctggtcggccgggaaactctcgtagagcggtgcgaaggcgtcggcgagcttcttcgcgccgtccgcgttcgcctgcgacagttccgcatactgcttcatgtcgtcgagtgcggagacgtcgtgcctggccatccgttcacgatagaggcggcccatcgtgtcgccgttgccgcgcatcgtgtcggcgaacgtcttccactgcggctcctgcgccgacgtgatcttcagctggtcgtgcaggtacttgatgcgctgctcgacgcgggcttcatggcgcgcctcgcgctgctcggcggtcggggccgaagccgcggctgcagttgtcgtggcctgagcgggcgcttgcggctgcgccggggtttgcgcgaacgcgctggctgcaacggcgagcgtagcgaggtgagcgagattttcttcatggttggctctccggggtggtgtctggcgagcgggcgcggcggcaattgccgcaagcgcgcatctcgcatcgccagctattagtagcacgttgagtgcggcgcagcagtgaatgcgacacttgcttacatccgatacgaatcgaaattgaaaggttcgaatcggttccgggcgatgcggtttgggcaggccggcgttcggcgctatcatcgcgtcaccttccactttgccggcacgtcgtgccccggcccagcctcatgcgtccaccccgcctcgaccaactcgacgatctcgaccggcaactcgtcgctgctgcaggccgatgcgcgggccagcgtcgcggatctcgcgcgccagctcgacgtcgcgcgcacgacggtcgtcgcacgcatcgcgcggctcgaacgtaccaacgtgatcgccggctacagcgtccggctcgggcaggacgtgctcgacgcgagcatttacgcgtatgtcggcatcatcctcacgccgaagttcggcaaggacgtgttgcgcaaactcgaccggatgcccgaagtgcagctgctgtgcgcggtgagcggcgagtacgactacgtcgcatggctgcgcgccgattcgcccgaacggctcaacgacctgctcgaccagatcggcacgctcgaaggcgtcgagcgcacgacgacgtcgatcatcctgtcgcgcaagatcg
